US012807952B2

(12) United States Patent
Lloyd et al.

(10) Patent No.: US 12,807,952 B2
(45) Date of Patent: Nov. 24, 2026

(54) COMPOSITIONS AND METHODS FOR TREATING NONALCOHOLIC FATTY LIVER DISEASE

(71) Applicant: Insitro, Inc., South San Francisco, CA (US)

(72) Inventors: David John Lloyd, Lafayette, CA (US); Santhosh Satapati, Dublin, CA (US); Sumit Mukherjee, Issaquah, WA (US); Hari Somineni, Quincy, MA (US); Arijit Bhowmick, Astoria, NY (US); Tanaya Walimbe, San Francisco, CA (US)

(73) Assignee: Insitro, Inc., South San Francisco, CA (US)

( * ) Notice: Subject to any disclaimer, the term of this patent is extended or adjusted under 35 U.S.C. 154(b) by 0 days.

(21) Appl. No.: 19/305,728

(22) Filed: Aug. 20, 2025

(65) Prior Publication Data

US 2026/0055407 A1 Feb. 26, 2026

Related U.S. Application Data

(60) Provisional application No. 63/685,369, filed on Aug. 21, 2024.

(51) Int. Cl.
*C12N 15/113* (2010.01)
*A61P 1/16* (2006.01)

(52) U.S. Cl.
CPC .............. *C12N 15/113* (2013.01); *A61P 1/16* (2018.01); *C12N 2310/14* (2013.01); *C12N 2310/321* (2013.01); *C12N 2310/322* (2013.01); *C12N 2310/351* (2013.01)

(58) Field of Classification Search
CPC .............. C12N 15/113; C12N 2310/14; C12N 2310/321; C12N 2310/322; C12N 2310/351; A61P 1/16
See application file for complete search history.

(56) References Cited

U.S. PATENT DOCUMENTS

| | | | |
|---|---|---|---|
| 4,235,871 A | 11/1980 | Papahadjopoulos et al. | |
| 4,501,728 A | 2/1985 | Geho et al. | |
| 4,837,028 A | 6/1989 | Allen | |
| 5,019,369 A | 5/1991 | Presant et al. | |
| 5,885,968 A | 3/1999 | Biessen et al. | |
| 5,976,567 A | 11/1999 | Wheeler et al. | |
| 5,981,501 A | 11/1999 | Wheeler et al. | |
| 6,534,484 B1 | 3/2003 | Wheeler et al. | |
| 6,586,410 B1 | 7/2003 | Wheeler et al. | |
| 6,815,432 B2 | 11/2004 | Wheeler et al. | |
| 8,034,376 B2 | 10/2011 | Manoharan et al. | |
| 8,090,542 B2 * | 1/2012 | Khvorova .......... | C12N 15/1135 435/6.1 |
| 9,771,591 B2 | 9/2017 | Bettencourt et al. | |
| 10,246,709 B2 | 4/2019 | Rozema et al. | |
| 10,294,474 B2 | 5/2019 | Li et al. | |
| 10,683,501 B2 | 6/2020 | Zimmermann et al. | |
| 2009/0304704 A1 | 12/2009 | Gerhard et al. | |
| 2010/0291681 A1 | 11/2010 | Khorova et al. | |
| 2010/0324120 A1 | 12/2010 | Chen et al. | |
| 2022/0143221 A1 | 5/2022 | Danos et al. | |
| 2024/0084387 A1 | 3/2024 | Khera et al. | |

FOREIGN PATENT DOCUMENTS

| | | |
|---|---|---|
| WO | WO-1996004096 A1 | 12/1996 |
| WO | WO-2000003683 A2 | 1/2000 |
| WO | WO-2000053722 A2 | 9/2000 |
| WO | WO-2005031002 A2 | 4/2005 |
| WO | WO-2008022309 A2 | 2/2008 |
| WO | WO-2011104169 A1 | 9/2011 |
| WO | WO-2012083185 A2 | 6/2012 |
| WO | WO-2013032829 A1 | 3/2013 |
| WO | WO-2013158141 A1 | 10/2013 |
| WO | WO-2014179620 A1 | 11/2014 |
| WO | WO-2018027106 A2 | 2/2018 |
| WO | WO-2018141908 A1 | 8/2018 |
| WO | WO-2022271806 A1 | 12/2022 |
| WO | WO-2025072748 A2 | 4/2025 |

OTHER PUBLICATIONS

Sciabola et al. ("PFRED: A computational platform for siRNA and antisense oligonucleotides design." PLoS One 16.1 (2021)).*
Al-Mahmood et al., (2009). "Potent in Vivo Antiangiogenic Effects of GS-101 (5'-TATCCGGAGGGCTCGCCATGCTGCT-3'), an Antisense Oligonucleotide Preventing the Expression of Insulin Receptor Substrate-1," Journal Of Pharmacology And Experimental Therapeutics, 329(2):496-504.
Baenziger et al., (1980). "Galactose and N-acetylgalactosamine-specific endocytosis of glycopeptides by isolated rat hepatocytes," Cell, 22:611-620.
Biessen et al., (1995). "Synthesis of Cluster Galactosides with High Affinity for the Hepatic Asialoglycoprotein Receptor," J. Med. Chem., 38:1538-1546.
Cesarone et al., (2006). "RNAi-mediated silencing of insulin receptor substrate 1 (IRS-1) enhances tamoxifen-induced cell death in MCF-7 breast cancer cells," Journal Of Cellular Biochemistry, 98(2):440-450.
Cesarone et al., (2007). "Insulin receptor substrate 1 knockdown in human MCF7 ER+ breast cancer cells by nuclease-resistant IRS1 siRNA conjugated to a disulfide-bridged D-Peptide analogue of insulin-like growth factor 1," Bioconjugate Chemistry, 18(6):1831-1840.

(Continued)

*Primary Examiner* — Kimberly Chong
(74) *Attorney, Agent, or Firm* — MORRISON & FOERSTER LLP

(57) ABSTRACT

Described are compositions and methods for inhibition of IRS1 gene expression. RNA interference (RNAi) agents for inhibiting the expression of IRS1 gene are described. The IRS1 RNAi agents disclosed herein may be targeted to cells, such as hepatocytes, for example, by using conjugated targeting ligands. Pharmaceutical compositions comprising one or more IRS RNAi agents optionally with one or more additional therapeutics are also described.

27 Claims, 4 Drawing Sheets

Specification includes a Sequence Listing.

(56) References Cited

OTHER PUBLICATIONS

Connolly et al., (1982). "Binding and endocytosis of cluster glycosides by rabbit hepatocytes. Evidence for a short-circuit pathway that does not lead to degradation," J. Biol. Chem., 257(2):939-945.
Crooke et al., (1996). "Pharmacokinetic properties of several novel oligonucleotide analogs in mice," J. Pharmacol. Exp. Ther., 277(2):923-937.
Egli et al., (2023). "Chemistry, structure and function of approved oligonucleotide therapeutics," Nucleic Acids Research, 51(6):2529-2573.
Elhafiz et al., (2020). "Imbalanced insulin substrate-1 and insulin substrate-2 signaling trigger hepatic steatosis in vitamin D deficient rats: 8-methoxypsoralen, a vitamin D receptor ligand with a promising anti-steatotic action," Biochim Biophys Acta Mol Cell Biol Lipids, 1865(6):158657, 44 pages.
Enooku et al., (2018). "Hepatic IRS1 and Beta-catenin expression is associated with histological progression and overt diabetes emergence in NAFLD patients," Journal Of Gastroenterlogy, 53(12):1261-1275.
Foster et al., (2018). "Advanced siRNA Designs Further Improve In Vivo Performance of GalNAc-siRNA Conjugates," Molecular Therapy, 26(3):708-717.
Honma et al., (2018). "Selective insulin resistance with differential expressions of IRS-1 and IRS-2 in human NAFLD livers," International Journal Of Obesity, 42(9):1544-1555.
Hu et al., (2020). "Therapeutic siRNA: state of the art," Signal Transduction And Targeted Therapy, 5:101, 25 pages.
International Search Report and Written Opinion received for International Patent Application No. PCT/US2024/048960 mailed on Mar. 25, 2025, 32 pages.
Invitation to pay additional fees received for International Patent Application No. PCT/US2024/048960 mailed on Feb. 3, 2025, 23 pages.
Iobst et al., (1996). "Selective sugar binding to the carbohydrate recognition domains of the rat hepatic and macrophage asialoglycoprotein receptors," J Biol Chem, 271(12):6686-93.
Kabanov et al., (1990). "A new class of antivirals: antisense oligonucleotides combined with a hydrophobic substituent effectively inhibit influenza virus reproduction and synthesis of virus-specific proteins in MDCK cells," FEBS Lett., 259(2):327-330.
Kumar et al., (2023). "Targeted delivery of oligonucleotides using multivalent protein-carbohydrate interactions," Chemical Society Reviews, 52(4):1273-1287.
Letsinger et al., (1989). "Cholesteryl-conjugated oligonucleotides: synthesis, properties, and activity as inhibitors of replication of human immunodeficiency virus in cell culture," PNAS USA, 86:6553-6556.
Manoharan et al., (1992). "Chemical modifications to improve uptake and bioavailability of antisense oligonucleotides," Ann. N.Y. Acad. Sci., 660:306-309.
Manoharan et al., (1993). "Introduction of a lipophilic thioether tether in the minor groove of nucleic acids for antisense applications," Bioorg. Med. Chem. Let., 3(12):2765-2770.
Manoharan et al., (1994). "Cholic acid-oligonucleotide conjugates for antisense applications," Bioorg. Med. Chem. Let., 4(8):1053-1060.
Manoharan et al., (1995). "Lipidic nucleic acids," Tetrahedron Lett., 36(21):3651-3654.
Manoharan et al., (1995). "Oligonucleotide Conjugates: Alteration of the Pharmacokinetic Properties of Antisense Agents," Nucleosides & Nucleotides, 14(3-5):969-973.
Mishra et al., (1995). "Improved leishmanicidal effect of phosphorotioate antisense oligonucleotides by LDL-mediated delivery," Biochim. Biophys. Acta, 1264:229-237.
Neuschwander-Tetri et al., (2003). "Nonalcoholic steatohepatitis: summary of an AASLD Single Topic Conference," Hepatology, 37(5):1202-1209.
Oberhauser et al., (1992). "Effective incorporation of 2'-O-methyl-oligoribonuclectides into liposomes and enhanced cell association through modification with thiocholesterol," Nucl. Acids Res., 20(3):533-538.
Saison-Behmoaras et al., (1991). "Short modified antisense oligonucleotides directed against Ha-ras point mutation induce selective cleavage of the mRNA and inhibit T24 cells proliferation," EMBO J, 10(5):1111-1118.
Sanyal, (2001). "Insulin Resistance and Nonalcoholic Steatohepatitis: Fat Or Fiction?" Am. J. Gastroenterol., 96(2):274-276.
Shea et al., (1990). "Synthesis, hybridization properties and antiviral activity of lipid-oligodeoxynucleotide conjugates," Nucl. Acids Res., 18(13):3777-3783.
Svinarchuk et al., (1993). "Inhibition of HIV proliferation in MT-4 cells by antisense oligonucleotide conjugated to lipophilic groups," Biochimie, 75:49-54.
Szoka et al., (1980). "Comparative properties and methods of preparation of lipid vesicles (liposomes)," Ann. Rev. Biophys. Bioeng., 9:467-508.
Varma et al., (2007). "Overexpression of Akt1 upregulates glycogen synthase activity and phosphorylation of mTOR in IRS-1 knock-down HepG2 cells," Journal Of Cellular Biochemistry, 103(5):1424-1437.
International Search Report and Written Opinion received for International Patent Application No. PCT/US2025/042823 mailed on Mar. 31, 2026, 24 pages.
GenBank, (2026). "*Homo sapiens* insulin receptor substrate 1 (IRS1), transcript variant 1, mRNA; Accession No. NM_005544.3," available online at <https://www.ncbi.nlm.nih.gov/nuccore/NM_005544.3/>, 10 pages.

* cited by examiner

COMPOSITIONS AND METHODS FOR TREATING NONALCOHOLIC FATTY LIVER DISEASE

CROSS-REFERENCE TO RELATED APPLICATIONS

This application claims the priority benefit of U.S. Provisional Application No. 63/685,369, filed on Aug. 21, 2024, and International Application No. PCT/US2024/048960, filed on Sep. 27, 2024, the contents of each of which are incorporated herein in its entirety.

REFERENCE TO AN ELECTRONIC SEQUENCE LISTING

The present application is being filed with a Sequence Listing in electronic format. The Sequence Listing is provided as a file entitled 208782001930SeqList.xml, created on Aug. 11, 2025, which is 8,250,391 bytes in size. The information in electronic format of the Sequence Listing is incorporated by reference in its entirety.

FIELD

The present disclosure relates to RNA interference (RNAi) agents to inhibit the expression of insulin receptor substrate-1 (IRS1). The disclosure also relates to compositions that include IRS1 RNAi agents and methods of use thereof, including the use of such IRS1 RNAi agents in the treatment of nonalcoholic fatty liver disease (NAFLD) and/or nonalcoholic steatohepatitis (NASH), also known as metabolic dysfunction-associated steatotic liver disease (MASLD) and/or metabolic dysfunction-associated steatohepatitis (MASH).

BACKGROUND

Nonalcoholic fatty liver disease (NAFLD) is a broad term for a range of liver conditions affecting people who drink little to no alcohol. The main characteristic of NAFLD is too much fat stored in liver cells. It is currently unknown exactly why some individuals accumulate fat in the liver while others do not. Some individuals with NAFLD can develop nonalcoholic steatohepatitis (NASH), an aggressive form of fatty liver disease, which is marked by steatosis, fibrosis, and liver inflammation and may progress to advanced scarring (cirrhosis) and liver failure.

NAFLD and NASH are both linked to being overweight or obese, insulin resistance, high blood sugar (hyperglycemia), and high levels of fats (particularly triglycerides) in the blood. NAFLD is also a risk factor for type 2 diabetes. Lifestyle modification remains the cornerstone of management of NAFLD and NASH including losing weight, keeping a healthy diet, limiting over the counter drugs, and avoiding alcohol. Additional treatment options include medications to reduce blood pressure or control diabetes. If NAFLD or NASH leads to cirrhosis, treatment of the complications of cirrhosis with medicines, minor medical procedures, and surgery may be necessary. Individuals with liver failure or liver cancer may need a liver transplant to restore health.

NAFLD is increasingly common around the world, especially in Western nations where it is the leading cause of liver disease. In the United States, it is the most common form of chronic liver disease, affecting about one-quarter of the population. It is a cause of end-stage liver disease, with increased mortality secondary to cirrhosis and its complications. No drug treatment has been approved by the Food and Drug Administration for nonalcoholic fatty liver disease-either non-alcoholic fatty liver or NASH. Therefore, there continues to be a need to for safe and effective treatments for NAFLD and NASH.

SUMMARY

Provided herein are RNA interference (RNAi) agents to inhibit the expression of insulin receptor substrate-1 (IRS1).

Described herein is an RNAi agent that inhibits expression of insulin receptor substrate-1 (IRS1) comprising an antisense strand and a sense strand that at least partially complements the antisense strand, wherein: (a) the antisense strand comprises at least 14 contiguous bases from any one of SEQ ID NOS: 1-96, 385-457, and 677-688; and/or (b) the sense strand comprises at least 14 contiguous bases from any one of SEQ ID NOS: 97-192, 458-530, and 689-700.

In some implementations, one or more bases of the antisense stand and/or the sense strand are modified. In some implementations, the antisense strand has a modification pattern according to nsNfsnnnNfnnnnnnnNfnNfnnnnnsnsn. In some implementations, the sense strand has a modification pattern according to nsnsnnnnNfnNfNfNfnnnnnnnnnsnsn. In some implementations, the sense strand has a modification pattern according to nsnsnnnnNfnNfNfNfnnnnnnnnnn. In some implementations, the antisense strand comprises at least 14 contiguous bases from any one of SEQ ID NOS: 193-288, 531-603, and 701-712. In some implementations, the sense strand comprises at least 14 contiguous bases from any one of SEQ ID NOS: 289-384, 604-676, 713-724, and 726-731. In some implementations, (a) the antisense strand comprises at least 14 contiguous bases from any one of SEQ ID NOS: 193-288, 531-603, and 701-712; and (b) the sense strand comprises at least 14 contiguous bases from any one of SEQ ID NOS: 289-384, 604-676, 713-724, and 726-731.

Also described herein is an RNAi agent that inhibits expression of insulin receptor substrate-1 (IRS1) comprising an antisense strand and a sense strand that at least partially complements the antisense strand, and a targeting ligand conjugated to the antisense strand or the sense strand, wherein the targeting ligand targets a hepatocyte.

In some implementations, the antisense strand comprises at least 14 contiguous bases that complement a sequence in an mRNA molecule that encodes IRS1 (SEQ ID NO: 725).

In some implementations, the antisense strand and the sense strand form a duplex of at least 14 bases in length. In some implementations, the antisense strand and the sense strand form a duplex of between 15 and 30 bases in length.

In some implementations, the antisense strand or a subsequence thereof differs by 0, 1, 2, 3, or 4 nucleotides from an equal length portion of any one of SEQ ID NOS: 1-96, 385-457, 677-688, 193-288, 531-603, and 701-712, wherein the subsequence is at least 14, 15, 16, 17, 18, 19, 20, or 21 bases in length.

In some implementations, the antisense strand comprises, in order, nucleotides 2-23 of any one of SEQ ID NOS: 1-96, 385-457, 677-688, 193-288, 531-603, and 701-712. In some implementations, the antisense strand comprises at least 14 contiguous bases from any one of SEQ ID NOS: 1-96, 385-457, 677-688, 193-288, 531-603, and 701-712. In some implementations, the antisense strand comprises, in order, nucleobases 1-14 of any one of SEQ ID NOS: 1-96, 385-457, 677-688, 193-288, 531-603, and 701-712. In some implementations, the antisense strand comprises at least 14 contiguous bases from any one of SEQ ID NOS: 449, 450, 457, 595, 596, 603, 677, 679, 680, 701, 703, and 704.

In some implementations, the sense strand or a subsequence thereof differs by 0, 1, 2, 3, or 4 nucleotides from an equal length portion of any one of SEQ ID NOS: 97-192, 458-530, 689-700, 289-384, 604-676, 713-724, and 726-731, wherein the subsequence is at least 14, 15, 16, 17, 18, 19, 20, or 21 bases in length. In some implementations, the sense strand comprises, in order, nucleotides 1-22 of any one of SEQ ID NOS: 97-192, 458-530, 689-700, 289-384, 604-676, 713-724, and 726-731. In some implementations, the sense strand comprises at least 14 contiguous bases from any one of SEQ ID NOS: 97-192, 458-530, 689-700, 289-384, 604-676, 713-724, and 726-731. In some implementations, the sense strand comprises, in order, nucleobases 1-14 of any one of SEQ ID NOS: 97-192, 458-530, 689-700, 289-384, 604-676, 713-724, and 726-731. In some implementations, the sense strand comprises at least 14 contiguous bases from any one of SEQ ID NOS: 522, 523, 530, 689, 691, 692, 668, 669, 676, 713, 715, 716, and 726-731.

In some implementations, the antisense strand comprises at least 16 contiguous bases that complement a sequence in an mRNA molecule that encodes IRS1 (SEQ ID NO: 725).

In some implementations, the antisense strand and the sense strand form a duplex of at least 16 bases in length.

In some implementations, the antisense strand comprises at least 16 contiguous bases from any one of SEQ ID NOS: 1-96, 385-457, 677-688, 193-288, 531-603, and 701-712. In some implementations, the antisense strand comprises at least 16 contiguous bases from any one of SEQ ID NOS: 449, 450, 457, 595, 596, 603, 677, 679, 680, 701, 703, and 704. In some implementations, the antisense strand comprises, in order, nucleobases 1-16, 1-17, 1-18, 1-19, 1-20, 1-21, 1-22, 1-23, 2-17, 2-18, 2-19, 2-20, 2-21, 2-22, 2-23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 1-96, 385-457, 677-688, 193-288, 531-603, and 701-712. In some implementations, the antisense strand comprises a nucleotide sequence according to any one of SEQ ID NOS: 1-96, 385-457, and 677-688. In some implementations, one or more nucleotides are modified. In some implementations, the antisense strand comprises a nucleotide sequence according to any one of SEQ ID NOS: 449, 450, 457, 677, 679, and 680. In some implementations, one or more nucleotides are modified. In some implementations, the antisense strand has a modification pattern according to nsNfsnnnNfnnnnnnnNfnNfnnnnnsnsn. In some implementations, the antisense strand comprises a modified nucleotide sequence according to any one of SEQ ID NOS: 193-288, 531-603, and 701-712. In some implementations, the antisense strand comprises a modified nucleotide sequence according to any one of SEQ ID NOS: 595, 596, 603, 701, 703, and 704.

In some implementations, the sense strand comprises at least 16 contiguous bases from any one of SEQ ID NOS: 97-192, 458-530, 689-700, 289-384, 604-676, 713-724, and 726-731. In some implementations, the sense strand comprises at least 16 contiguous bases from any one of SEQ ID NOS: 522, 523, 530, 689, 691, 692, and 726-731. In some implementations, the sense strand comprises, in order, nucleobases 1-16, 1-17, 1-18, 1-19, 1-20, 1-21, 1-22, 1-23, 2-17, 2-18, 2-19, 2-20, 2-21, 2-22, 2-23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 97-192, 458-530, 689-700, 289-384, 604-676, 713-724, and 726-731. In some implementations, the sense strand comprises a nucleobase sequence according to any one of SEQ ID NOS: 97-192, 458-530, and 689-700. In some implementations, one or more nucleotides are modified. In some implementations, the sense strand comprises a nucleobase sequence according to any one of SEQ ID NOS: 522, 523, 530, 689, 691, and 692. In some implementations, one or more nucleotides are modified. In some implementations, the sense strand has a modification pattern according to nsnsnnnnNfnNfNfNfnnnnnnnnsnsn. In some implementations, the sense strand has a modification pattern according to nsnsnnnnNfnNfNfNfnnnnnnnnnn. In some implementations, the sense strand comprises a modified nucleotide sequence according to any one of SEQ ID NOS: 289-384, 604-676, 713-724, and 726-731. In some implementations, the sense strand comprises a modified nucleotide sequence according to any one of SEQ ID NOS: 668, 669, 676, 713, 715, 716, and 726-731.

In some implementations, (a) the sense strand comprises a nucleobase sequence according to SEQ ID NO: 97 and the antisense strand comprises a nucleobase sequence according to SEQ ID NO: 1; (b) the sense strand comprises a nucleobase sequence according to SEQ ID NO: 98 and the antisense strand comprises a nucleobase sequence according to SEQ ID NO: 2; (c) the sense strand comprises a nucleobase sequence according to SEQ ID NO: 99 and the antisense strand comprises a nucleobase sequence according to SEQ ID NO: 3; (d) the sense strand comprises a nucleobase sequence according to SEQ ID NO: 100 and the antisense strand comprises a nucleobase sequence according to SEQ ID NO: 4; (e) the sense strand comprises a nucleobase sequence according to SEQ ID NO: 101 and the antisense strand comprises a nucleobase sequence according to SEQ ID NO: 5; (f) the sense strand comprises a nucleobase sequence according to SEQ ID NO: 102 and the antisense strand comprises a nucleobase sequence according to SEQ ID NO: 6; (g) the sense strand comprises a nucleobase sequence according to SEQ ID NO: 103 and the antisense strand comprises a nucleobase sequence according to SEQ ID NO: 7; (h) the sense strand comprises a nucleobase sequence according to SEQ ID NO: 104 and the antisense strand comprises a nucleobase sequence according to SEQ ID NO: 8; (i) the sense strand comprises a nucleobase sequence according to SEQ ID NO: 105 and the antisense strand comprises a nucleobase sequence according to SEQ ID NO: 9; (j) the sense strand comprises a nucleobase sequence according to SEQ ID NO: 106 and the antisense strand comprises a nucleobase sequence according to SEQ ID NO: 10; (k) the sense strand comprises a nucleobase sequence according to SEQ ID NO: 107 and the antisense strand comprises a nucleobase sequence according to SEQ ID NO: 11; (l) the sense strand comprises a nucleobase sequence according to SEQ ID NO: 108 and the antisense strand comprises a nucleobase sequence according to SEQ ID NO: 12; (m) the sense strand comprises a nucleobase sequence according to SEQ ID NO: 109 and the antisense strand comprises a nucleobase sequence according to SEQ ID NO: 13; (n) the sense strand comprises a nucleobase sequence according to SEQ ID NO: 110 and the antisense strand comprises a nucleobase sequence according to SEQ ID NO: 14; (o) the sense strand comprises a nucleobase sequence according to SEQ ID NO: 111 and the antisense strand comprises a nucleobase sequence according to SEQ ID NO: 15; (p) the sense strand comprises a nucleobase sequence according to SEQ ID NO: 112 and the antisense strand comprises a nucleobase sequence according to SEQ ID NO: 16; (q) the sense strand comprises a nucleobase sequence according to SEQ ID NO: 113 and the antisense strand comprises a nucleobase sequence according to SEQ ID NO: 17; (r) the sense strand comprises a nucleobase sequence according to SEQ ID NO: 114 and the antisense strand comprises a nucleobase sequence according to SEQ ID NO: 18; (s) the sense strand comprises a nucleobase sequence according to SEQ ID NO: 115 and the antisense strand comprises a nucleobase sequence according to SEQ ID NO: 19; (t) the sense strand comprises a nucleobase sequence according to SEQ ID NO: 116 and the antisense strand comprises a nucleobase sequence according to SEQ ID NO: 20; (u) the sense strand comprises a nucleobase sequence according to SEQ ID NO: 117 and the antisense strand comprises a nucleobase sequence according to SEQ ID NO: 21; (v) the sense strand comprises a nucleobase sequence according to SEQ ID NO: 118 and the antisense strand comprises a nucleobase sequence according to SEQ ID NO: 22; (w) the sense strand comprises a nucleobase sequence according to SEQ ID NO: 119 and the antisense strand comprises a nucleobase sequence according to SEQ ID NO: 23; (x) the sense strand comprises a nucleobase sequence according to SEQ ID NO: 120 and the antisense strand comprises a nucleobase sequence according to SEQ ID NO: 24; (y) the sense strand comprises a nucleobase sequence according to SEQ ID NO: 121 and the antisense strand comprises a nucleobase sequence according to SEQ ID NO: 25; (z) the sense strand comprises a nucleobase sequence according to SEQ ID NO: 122 and the antisense strand comprises a nucleobase sequence according to SEQ ID NO: 26; (aa) the sense strand comprises a nucleobase sequence according to SEQ ID NO: 123 and the antisense strand comprises a nucleobase sequence according to SEQ ID NO: 27; (bb) the sense strand comprises a nucleobase sequence according to SEQ ID NO: 124 and the antisense strand comprises a nucleobase sequence according to SEQ ID NO: 28; (cc) the sense strand comprises a nucleobase sequence according to SEQ ID NO: 125 and the antisense strand comprises a nucleobase sequence according to SEQ ID NO: 29; (dd) the sense strand comprises a nucleobase sequence according to SEQ ID NO: 126 and the antisense strand comprises a nucleobase sequence according to SEQ ID NO: 30; (ee) the sense strand comprises a nucleobase sequence according to SEQ ID NO: 127 and the antisense strand comprises a nucleobase sequence according to SEQ ID NO: 31; (ff) the sense strand comprises a nucleobase sequence according to SEQ ID NO: 128 and the antisense strand comprises a nucleobase sequence according to SEQ ID NO: 32; (gg) the sense strand comprises a nucleobase sequence according to SEQ ID NO: 129 and the antisense strand comprises a nucleobase sequence according to SEQ ID NO: 33; (hh) the sense strand comprises a nucleobase sequence according to SEQ ID NO: 130 and the antisense strand comprises a nucleobase sequence according to SEQ ID NO: 34; (ii) the sense strand comprises a nucleobase sequence according to SEQ ID NO: 131 and the antisense strand comprises a nucleobase sequence according to SEQ ID NO: 35; (jj) the sense strand comprises a nucleobase sequence according to SEQ ID NO: 132 and the antisense strand comprises a nucleobase sequence according to SEQ ID NO: 36; (kk) the sense strand comprises a nucleobase sequence according to SEQ ID NO: 133 and the antisense strand comprises a nucleobase sequence according to SEQ ID NO: 37; (ll) the sense strand comprises a nucleobase sequence according to SEQ ID NO: 134 and the antisense strand comprises a nucleobase sequence according to SEQ ID NO: 38; (mm) the sense strand comprises a nucleobase sequence according to SEQ ID NO: 135 and the antisense strand comprises a nucleobase sequence according to SEQ ID NO: 39; (nn) the sense strand comprises a nucleobase sequence according to SEQ ID NO: 136 and the antisense strand comprises a nucleobase sequence according to SEQ ID NO: 40; (oo) the sense strand comprises a nucleobase sequence according to SEQ ID NO: 137 and the antisense strand comprises a nucleobase sequence according to SEQ ID NO: 41; (pp) the sense strand comprises a nucleobase sequence according to SEQ ID NO: 138 and the antisense strand comprises a nucleobase sequence according to SEQ ID NO: 42; (qq) the sense strand comprises a nucleobase sequence according to SEQ ID NO: 139 and the antisense strand comprises a nucleobase sequence according to SEQ ID NO: 43; (rr) the sense strand comprises a nucleobase sequence according to SEQ ID NO: 140 and the antisense strand comprises a nucleobase sequence according to SEQ ID NO: 44; (ss) the sense strand comprises a nucleobase sequence according to SEQ ID NO: 141 and the antisense strand comprises a nucleobase sequence according to SEQ ID NO: 45; (tt) the sense strand comprises a nucleobase sequence according to SEQ ID NO: 142 and the antisense strand comprises a nucleobase sequence according to SEQ ID NO: 46; (uu) the sense strand comprises a nucleobase sequence according to SEQ ID NO: 143 and the antisense strand comprises a nucleobase sequence according to SEQ ID NO: 47; (vv) the sense strand comprises a nucleobase sequence according to SEQ ID NO: 144 and the antisense strand comprises a nucleobase sequence according to SEQ ID NO: 48; (ww) the sense strand comprises a nucleobase sequence according to SEQ ID NO: 145 and the antisense strand comprises a nucleobase sequence according to SEQ ID NO: 49; (xx) the sense strand comprises a nucleobase sequence according to SEQ ID NO: 146 and the antisense strand comprises a nucleobase sequence according to SEQ ID NO: 50; (yy) the sense strand comprises a nucleobase sequence according to SEQ ID NO: 147 and the antisense strand comprises a nucleobase sequence according to SEQ ID NO: 51; (zz) the sense strand comprises a nucleobase sequence according to SEQ ID NO: 148 and the antisense strand comprises a nucleobase sequence according to SEQ ID NO: 52; (aaa) the sense strand comprises a nucleobase sequence according to SEQ ID NO: 149 and the antisense strand comprises a nucleobase sequence according to SEQ ID NO: 53; (bbb) the sense strand comprises a nucleobase sequence according to SEQ ID NO: 150 and the antisense strand comprises a nucleobase sequence according to SEQ ID NO: 54; (ccc) the sense strand comprises a nucleobase sequence according to SEQ ID NO: 151 and the antisense strand comprises a nucleobase sequence according to SEQ ID NO: 55; (ddd) the sense strand comprises a nucleobase sequence according to SEQ ID NO: 152 and the antisense strand comprises a nucleobase sequence according to SEQ ID NO: 56; (eee) the sense strand comprises a nucleobase sequence according to SEQ ID NO: 153 and the antisense strand comprises a nucleobase sequence according to SEQ ID NO: 57; (fff) the sense strand comprises a nucleobase sequence according to SEQ ID NO: 154 and the antisense strand comprises a nucleobase sequence according to SEQ ID NO: 58; (ggg) the sense strand comprises a nucleobase sequence according to SEQ ID NO: 155 and the antisense strand comprises a nucleobase sequence according to SEQ ID NO: 59; (hhh) the sense strand comprises a nucleobase sequence according to SEQ ID NO: 156 and the antisense strand comprises a nucleobase sequence according to SEQ ID NO: 60; (iii) the sense strand comprises a nucleobase sequence according to SEQ ID NO: 157 and the antisense strand comprises a nucleobase sequence according to SEQ ID NO: 61; (jjj) the sense strand comprises a nucleobase sequence according to SEQ ID NO: 158 and the antisense strand comprises a nucleobase sequence according to SEQ ID NO: 62; (kkk) the sense strand comprises a nucleobase sequence according to SEQ ID NO: 159 and the antisense strand comprises a nucleobase sequence according to SEQ ID NO: 63; (lll) the sense strand comprises a nucleobase sequence according to SEQ ID NO: 160 and the antisense strand comprises a nucleobase sequence according to SEQ ID NO: 64; (mmm) the sense strand comprises a nucleobase sequence according to SEQ ID NO: 161 and the antisense strand comprises a nucleobase sequence according to SEQ ID NO: 65; (nnn) the sense strand comprises a nucleobase sequence according to SEQ ID NO: 162 and the antisense strand comprises a nucleobase sequence according to SEQ ID NO: 66; (ooo) the sense strand comprises a nucleobase sequence according to SEQ ID NO: 163 and the antisense strand comprises a nucleobase sequence according to SEQ ID NO: 67; (ppp) the sense strand comprises a nucleobase sequence according to SEQ ID NO: 164 and the antisense strand comprises a nucleobase sequence according to SEQ ID NO: 68; (qqq) the sense strand comprises a nucleobase sequence according to SEQ ID NO: 165 and the antisense strand comprises a nucleobase sequence according to SEQ ID NO: 69; (rrr) the sense strand comprises a nucleobase sequence according to SEQ ID NO: 166 and the antisense strand comprises a nucleobase sequence according to SEQ ID NO: 70; (sss) the sense strand comprises a nucleobase sequence according to SEQ ID NO: 167 and the antisense strand comprises a nucleobase sequence according to SEQ ID NO: 71; (ttt) the sense strand comprises a nucleobase sequence according to SEQ ID NO: 168 and the antisense strand comprises a nucleobase sequence according to SEQ ID NO: 72; (uuu) the sense strand comprises a nucleobase sequence according to SEQ ID NO: 169 and the antisense strand comprises a nucleobase sequence according to SEQ ID NO: 73; (vvv) the sense strand comprises a nucleobase sequence according to SEQ ID NO: 170 and the antisense strand comprises a nucleobase sequence according to SEQ ID NO: 74; (www) the sense strand comprises a nucleobase sequence according to SEQ ID NO: 171 and the antisense strand comprises a nucleobase sequence according to SEQ ID NO: 75; (xxx) the sense strand comprises a nucleobase sequence according to SEQ ID NO: 172 and the antisense strand comprises a nucleobase sequence according to SEQ ID NO: 76; (yyy) the sense strand comprises a nucleobase sequence according to SEQ ID NO: 173 and the antisense strand comprises a nucleobase sequence according to SEQ ID NO: 77; (zzz) the sense strand comprises a nucleobase sequence according to SEQ ID NO: 174 and the antisense strand comprises a nucleobase sequence according to SEQ ID NO: 78; (aaaa) the sense strand comprises a nucleobase sequence according to SEQ ID NO: 175 and the antisense strand comprises a nucleobase sequence according to SEQ ID NO: 79; (bbbb) the sense strand comprises a nucleobase sequence according to SEQ ID NO: 176 and the antisense strand comprises a nucleobase sequence according to SEQ ID NO: 80; (cccc) the sense strand comprises a nucleobase sequence according to SEQ ID NO: 177 and the antisense strand comprises a nucleobase sequence according to SEQ ID NO: 81; (dddd) the sense strand comprises a nucleobase sequence according to SEQ ID NO: 178 and the antisense strand comprises a nucleobase sequence according to SEQ ID NO: 82; (eeee) the sense strand comprises a nucleobase sequence according to SEQ ID NO: 179 and the antisense strand comprises a nucleobase sequence according to SEQ ID NO: 83; (ffff) the sense strand comprises a nucleobase sequence according to SEQ ID NO: 180 and the antisense strand comprises a nucleobase sequence according to SEQ ID NO: 84; (gggg) the sense strand comprises a nucleobase sequence according to SEQ ID NO: 181 and the antisense strand comprises a nucleobase sequence according to SEQ ID NO: 85; (hhhh) the sense strand comprises a nucleobase sequence according to SEQ ID NO: 182 and the antisense strand comprises a nucleobase sequence according to SEQ ID NO: 86; (iiii) the sense strand comprises a nucleobase sequence according to SEQ ID NO: 183 and the antisense strand comprises a nucleobase sequence according to SEQ ID NO: 87; (jjjj) the sense strand comprises a nucleobase sequence according to SEQ ID NO: 184 and the antisense strand comprises a nucleobase sequence according to SEQ ID NO: 88; (kkkk) the sense strand comprises a nucleobase sequence according to SEQ ID NO: 185 and the antisense strand comprises a nucleobase sequence according to SEQ ID NO: 89; (llll) the sense strand comprises a nucleobase sequence according to SEQ ID NO: 186 and the antisense strand comprises a nucleobase sequence according to SEQ ID NO: 90; (mmmm) the sense strand comprises a nucleobase sequence according to SEQ ID NO: 187 and the antisense strand comprises a nucleobase sequence according to SEQ ID NO: 91; (nnnn) the sense strand comprises a nucleobase sequence according to SEQ ID NO: 188 and the antisense strand comprises a nucleobase sequence according to SEQ ID NO: 92; (oooo) the sense strand comprises a nucleobase sequence according to SEQ ID NO: 189 and the antisense strand comprises a nucleobase sequence according to SEQ ID NO: 93; (pppp) the sense strand comprises a nucleobase sequence according to SEQ ID NO: 190 and the antisense strand comprises a nucleobase sequence according to SEQ ID NO: 94; (qqqq) the sense strand comprises a nucleobase sequence according to SEQ ID NO: 191 and the antisense strand comprises a nucleobase sequence according to SEQ ID NO: 95; (rrrr) the sense strand comprises a nucleobase sequence according to SEQ ID NO: 192 and the antisense strand comprises a nucleobase sequence according to SEQ ID NO: 96; (ssss) the sense strand comprises a nucleobase sequence according to SEQ ID NO: 458 and the antisense strand comprises a nucleobase sequence according to SEQ ID NO: 385; (tttt) the sense strand comprises a nucleobase sequence according to SEQ ID NO: 459 and the antisense strand comprises a nucleobase sequence according to SEQ ID NO: 386; (uuuu) the sense strand comprises a nucleobase sequence according to SEQ ID NO: 460 and the antisense strand comprises a nucleobase sequence according to SEQ ID NO: 387; (vvvv) the sense strand comprises a nucleobase sequence according to SEQ ID NO: 461 and the antisense strand comprises a nucleobase sequence according to SEQ ID NO: 388; (wwww) the sense strand comprises a nucleobase sequence according to SEQ ID NO: 462 and the antisense strand comprises a nucleobase sequence according to SEQ ID NO: 389; (xxxx) the sense strand comprises a nucleobase sequence according to SEQ ID NO: 463 and the antisense strand comprises a nucleobase sequence according to SEQ ID NO: 390; (yyyy) the sense strand comprises a nucleobase sequence according to SEQ ID NO: 464 and the antisense strand comprises a nucleobase sequence according to SEQ ID NO: 391; (zzzz) the sense strand comprises a nucleobase sequence according to SEQ ID NO: 465 and the antisense strand comprises a nucleobase sequence according to SEQ ID NO: 392; (aaaaa) the sense strand comprises a nucleobase sequence according to SEQ ID NO: 466 and the antisense strand comprises a nucleobase sequence according to SEQ ID NO: 393; (bbbbb) the sense strand comprises a nucleobase sequence according to SEQ ID NO: 467 and the antisense strand comprises a nucleobase sequence according to SEQ ID NO: 394; (ccccc) the sense strand comprises a nucleobase sequence according to SEQ ID NO: 468 and the antisense strand comprises a nucleobase sequence according to SEQ ID NO: 395; (ddddd) the sense strand comprises a nucleobase sequence according to SEQ ID NO: 469 and the antisense strand comprises a nucleobase sequence according to SEQ ID NO: 396; (eeeee) the sense strand comprises a nucleobase sequence according to SEQ ID NO: 470 and the antisense strand comprises a nucleobase sequence according to SEQ ID NO: 397; (fffff) the sense strand comprises a nucleobase sequence according to SEQ ID NO: 471 and the antisense strand comprises a nucleobase sequence according to SEQ ID NO: 398; (ggggg) the sense strand comprises a nucleobase sequence according to SEQ ID NO: 472 and the antisense strand comprises a nucleobase sequence according to SEQ ID NO: 399; (hhhhh) the sense strand comprises a nucleobase sequence according to SEQ ID NO: 473 and the antisense strand comprises a nucleobase sequence according to SEQ ID NO: 400; (iiiii) the sense strand comprises a nucleobase sequence according to SEQ ID NO: 474 and the antisense strand comprises a nucleobase sequence according to SEQ ID NO: 401; (jjjjj) the sense strand comprises a nucleobase sequence according to SEQ ID NO: 475 and the antisense strand comprises a nucleobase sequence according to SEQ ID NO: 402; (kkkkk) the sense strand comprises a nucleobase sequence according to SEQ ID NO: 476 and the antisense strand comprises a nucleobase sequence according to SEQ ID NO: 403; (lllll) the sense strand comprises a nucleobase sequence according to SEQ ID NO: 477 and the antisense strand comprises a nucleobase sequence according to SEQ ID NO: 404; (mmmmm) the sense strand comprises a nucleobase sequence according to SEQ ID NO: 478 and the antisense strand comprises a nucleobase sequence according to SEQ ID NO: 405; (nnnnn) the sense strand comprises a nucleobase sequence according to SEQ ID NO: 479 and the antisense strand comprises a nucleobase sequence according to SEQ ID NO: 406; (ooooo) the sense strand comprises a nucleobase sequence according to SEQ ID NO: 480 and the antisense strand comprises a nucleobase sequence according to SEQ ID NO: 407; (ppppp) the sense strand comprises a nucleobase sequence according to SEQ ID NO: 481 and the antisense strand comprises a nucleobase sequence according to SEQ ID NO: 408; (qqqqq) the sense strand comprises a nucleobase sequence according to SEQ ID NO: 482 and the antisense strand comprises a nucleobase sequence according to SEQ ID NO: 409; (rrrrr) the sense strand comprises a nucleobase sequence according to SEQ ID NO: 483 and the antisense strand comprises a nucleobase sequence according to SEQ ID NO: 410; (sssss) the sense strand comprises a nucleobase sequence according to SEQ ID NO: 484 and the antisense strand comprises a nucleobase sequence according to SEQ ID NO: 411; (ttttt) the sense strand comprises a nucleobase sequence according to SEQ ID NO: 485 and the antisense strand comprises a nucleobase sequence according to SEQ ID NO: 412; (uuuuu) the sense strand comprises a nucleobase sequence according to SEQ ID NO: 486 and the antisense strand comprises a nucleobase sequence according to SEQ ID NO: 413; (vvvvv) the sense strand comprises a nucleobase sequence according to SEQ ID NO: 487 and the antisense strand comprises a nucleobase sequence according to SEQ ID NO: 414; (wwwww) the sense strand comprises a nucleobase sequence according to SEQ ID NO: 488 and the antisense strand comprises a nucleobase sequence according to SEQ ID NO: 415; (xxxxx) the sense strand comprises a nucleobase sequence according to SEQ ID NO: 489 and the antisense strand comprises a nucleobase sequence according to SEQ ID NO: 416; (yyyyy) the sense strand comprises a nucleobase sequence according to SEQ ID NO: 490 and the antisense strand comprises a nucleobase sequence according to SEQ ID NO: 417; (zzzzz) the sense strand comprises a nucleobase sequence according to SEQ ID NO: 491 and the antisense strand comprises a nucleobase sequence according to SEQ ID NO: 418; (aaaaaa) the sense strand comprises a nucleobase sequence according to SEQ ID NO: 492 and the antisense strand comprises a nucleobase sequence according to SEQ ID NO: 419; (bbbbbb) the sense strand comprises a nucleobase sequence according to SEQ ID NO: 493 and the antisense strand comprises a nucleobase sequence according to SEQ ID NO: 420; (cccccc) the sense strand comprises a nucleobase sequence according to SEQ ID NO: 494 and the antisense strand comprises a nucleobase sequence according to SEQ ID NO: 421; (dddddd) the sense strand comprises a nucleobase sequence according to SEQ ID NO: 495 and the antisense strand comprises a nucleobase sequence according to SEQ ID NO: 422; (eeeeee) the sense strand comprises a nucleobase sequence according to SEQ ID NO: 496 and the antisense strand comprises a nucleobase sequence according to SEQ ID NO: 423; (ffffff) the sense strand comprises a nucleobase sequence according to SEQ ID NO: 497 and the antisense strand comprises a nucleobase sequence according to SEQ ID NO: 424; (gggggg) the sense strand comprises a nucleobase sequence according to SEQ ID NO: 498 and the antisense strand comprises a nucleobase sequence according to SEQ ID NO: 425; (hhhhhh) the sense strand comprises a nucleobase sequence according to SEQ ID NO: 499 and the antisense strand comprises a nucleobase sequence according to SEQ ID NO: 426; (iiiiii) the sense strand comprises a nucleobase sequence according to SEQ ID NO: 500 and the antisense strand comprises a nucleobase sequence according to SEQ ID NO: 427; (jjjjjj) the sense strand comprises a nucleobase sequence according to SEQ ID NO: 501 and the antisense strand comprises a nucleobase sequence according to SEQ ID NO: 428; (kkkkkk) the sense strand comprises a nucleobase sequence according to SEQ ID NO: 502 and the antisense strand comprises a nucleobase sequence according to SEQ ID NO: 429; (llllll) the sense strand comprises a nucleobase sequence according to SEQ ID NO: 503 and the antisense strand comprises a nucleobase sequence according to SEQ ID NO: 430; (mmmmmm) the sense strand comprises a nucleobase sequence according to SEQ ID NO: 504 and the antisense strand comprises a nucleobase sequence according to SEQ ID NO: 431; (nnnnnn) the sense strand comprises a nucleobase sequence according to SEQ ID NO: 505 and the antisense strand comprises a nucleobase sequence according to SEQ ID NO: 432; (oooooo) the sense strand comprises a nucleobase sequence according to SEQ ID NO: 506 and the antisense strand comprises a nucleobase sequence according to SEQ ID NO: 433; (pppppp) the sense strand comprises a nucleobase sequence according to SEQ ID NO: 507 and the antisense strand comprises a nucleobase sequence according to SEQ ID NO: 434; (qqqqqq) the sense strand comprises a nucleobase sequence according to SEQ ID NO: 508 and the antisense strand comprises a nucleobase sequence according to SEQ ID NO: 435; (rrrrrr) the sense strand comprises a nucleobase sequence according to SEQ ID NO: 509 and the antisense strand comprises a nucleobase sequence according to SEQ ID NO: 436; (ssssss) the sense strand comprises a nucleobase sequence according to SEQ ID NO: 510 and the antisense strand comprises a nucleobase sequence according to SEQ ID NO: 437; (tttttt) the sense strand comprises a nucleobase sequence according to SEQ ID NO: 511 and the antisense strand comprises a nucleobase sequence according to SEQ ID NO: 438; (uuuuuu) the sense strand comprises a nucleobase sequence according to SEQ ID NO: 512 and the antisense strand comprises a nucleobase sequence according to SEQ ID NO: 439; (vvvvvv) the sense strand comprises a nucleobase sequence according to SEQ ID NO: 513 and the antisense strand comprises a nucleobase sequence according to SEQ ID NO: 440; (wwwwww) the sense strand comprises a nucleobase sequence according to SEQ ID NO: 514 and the antisense strand comprises a nucleobase sequence according to SEQ ID NO: 441; (xxxxxx) the sense strand comprises a nucleobase sequence according to SEQ ID NO: 515 and the antisense strand comprises a nucleobase sequence according to SEQ ID NO: 442; (yyyyyy) the sense strand comprises a nucleobase sequence according to SEQ ID NO: 516 and the antisense strand comprises a nucleobase sequence according to SEQ ID NO: 443; (zzzzzz) the sense strand comprises a nucleobase sequence according to SEQ ID NO: 517 and the antisense strand comprises a nucleobase sequence according to SEQ ID NO: 444; (aaaaaaa) the sense strand comprises a nucleobase sequence according to SEQ ID NO: 518 and the antisense strand comprises a nucleobase sequence according to SEQ ID NO: 445; (bbbbbbb) the sense strand comprises a nucleobase sequence according to SEQ ID NO: 519 and the antisense strand comprises a nucleobase sequence according to SEQ ID NO: 446; (ccccccc) the sense strand comprises a nucleobase sequence according to SEQ ID NO: 520 and the antisense strand comprises a nucleobase sequence according to SEQ ID NO: 447; (ddddddd) the sense strand comprises a nucleobase sequence according to SEQ ID NO: 521 and the antisense strand comprises a nucleobase sequence according to SEQ ID NO: 448; (eeeeeee) the sense strand comprises a nucleobase sequence according to SEQ ID NO: 522 and the antisense strand comprises a nucleobase sequence according to SEQ ID NO: 449; (fffffff) the sense strand comprises a nucleobase sequence according to SEQ ID NO: 523 and the antisense strand comprises a nucleobase sequence according to SEQ ID NO: 450; (ggggggg) the sense strand comprises a nucleobase sequence according to SEQ ID NO: 524 and the antisense strand comprises a nucleobase sequence according to SEQ ID NO: 451; (hhhhhhh) the sense strand comprises a nucleobase sequence according to SEQ ID NO: 525 and the antisense strand comprises a nucleobase sequence according to SEQ ID NO: 452; (iiiiiii) the sense strand comprises a nucleobase sequence according to SEQ ID NO: 526 and the antisense strand comprises a nucleobase sequence according to SEQ ID NO: 453; (jjjjjjj) the sense strand comprises a nucleobase sequence according to SEQ ID NO: 527 and the antisense strand comprises a nucleobase sequence according to SEQ ID NO: 454; (kkkkkkk) the sense strand comprises a nucleobase sequence according to SEQ ID NO: 528 and the antisense strand comprises a nucleobase sequence according to SEQ ID NO: 455; (lllllll) the sense strand comprises a nucleobase sequence according to SEQ ID NO: 529 and the antisense strand comprises a nucleobase sequence according to SEQ ID NO: 456; (mmmmmmm) the sense strand comprises a nucleobase sequence according to SEQ ID NO: 530 and the antisense strand comprises a nucleobase sequence according to SEQ ID NO: 457; (nnnnnnn) the sense strand comprises a nucleobase sequence according to SEQ ID NO: 689 and the antisense strand comprises a nucleobase sequence according to SEQ ID NO: 677; (ooooooo) the sense strand comprises a nucleobase sequence according to SEQ ID NO: 690 and the antisense strand comprises a nucleobase sequence according to SEQ ID NO: 678; (ppppppp) the sense strand comprises a nucleobase sequence according to SEQ ID NO: 691 and the antisense strand comprises a nucleobase sequence according to SEQ ID NO: 679; (qqqqqqq) the sense strand comprises a nucleobase sequence according to SEQ ID NO: 692 and the antisense strand comprises a nucleobase sequence according to SEQ ID NO: 680; (rrrrrrr) the sense strand comprises a nucleobase sequence according to SEQ ID NO: 693 and the antisense strand comprises a nucleobase sequence according to SEQ ID NO: 681; (sssssss) the sense strand comprises a nucleobase sequence according to SEQ ID NO: 694 and the antisense strand comprises a nucleobase sequence according to SEQ ID NO: 682; (ttttttt) the sense strand comprises a nucleobase sequence according to SEQ ID NO: 695 and the antisense strand comprises a nucleobase sequence according to SEQ ID NO: 683; (uuuuuuu) the sense strand comprises a nucleobase sequence according to SEQ ID NO: 696 and the antisense strand comprises a nucleobase sequence according to SEQ ID NO: 684; (vvvvvvv) the sense strand comprises a nucleobase sequence according to SEQ ID NO: 697 and the antisense strand comprises a nucleobase sequence according to SEQ ID NO: 685; (wwwwwww) the sense strand comprises a nucleobase sequence according to SEQ ID NO: 698 and the antisense strand comprises a nucleobase sequence according to SEQ ID NO: 686; (xxxxxxx) the sense strand comprises a nucleobase sequence according to SEQ ID NO: 699 and the antisense strand comprises a nucleobase sequence according to SEQ ID NO: 687; or (yyyyyyy) the sense strand comprises a nucleobase sequence according to SEQ ID NO: 700 and the antisense strand comprises a nucleobase sequence according to SEQ ID NO: 688.

In some implementations, (a) the sense strand comprises a nucleobase sequence according to SEQ ID NO: 530 and the antisense strand comprises a nucleobase sequence according to SEQ ID NO: 457; (b) the sense strand comprises a nucleobase sequence according to SEQ ID NO: 523 and the antisense strand comprises a nucleobase sequence according to SEQ ID NO: 450; (c) the sense strand comprises a nucleobase sequence according to SEQ ID NO: 691 and the antisense strand comprises a nucleobase sequence according to SEQ ID NO: 679; (d) the sense strand comprises a nucleobase sequence according to SEQ ID NO: 689 and the antisense strand comprises a nucleobase sequence according to SEQ ID NO: 677; (e) the sense strand comprises a nucleobase sequence according to SEQ ID NO: 522 and the antisense strand comprises a nucleobase sequence according to SEQ ID NO: 449; or (f) the sense strand comprises a nucleobase sequence according to SEQ ID NO: 692 and the antisense strand comprises a nucleobase sequence according to SEQ ID NO: 680.

In some implementations, (a) the sense strand comprises a modified nucleotide sequence according to SEQ ID NO: 289 and the antisense strand comprises a modified nucleotide sequence according to SEQ ID NO: 193; (b) the sense strand comprises a modified nucleotide sequence according to SEQ ID NO: 290 and the antisense strand comprises a modified nucleotide sequence according to SEQ ID NO: 194; (c) the sense strand comprises a modified nucleotide sequence according to SEQ ID NO: 291 and the antisense strand comprises a modified nucleotide sequence according to SEQ ID NO: 195; (d) the sense strand comprises a modified nucleotide sequence according to SEQ ID NO: 292 and the antisense strand comprises a modified nucleotide sequence according to SEQ ID NO: 196; (e) the sense strand comprises a modified nucleotide sequence according to SEQ ID NO: 293 and the antisense strand comprises a modified nucleotide sequence according to SEQ ID NO: 197; (f) the sense strand comprises a modified nucleotide sequence according to SEQ ID NO: 294 and the antisense strand comprises a modified nucleotide sequence according to SEQ ID NO: 198; (g) the sense strand comprises a modified nucleotide sequence according to SEQ ID NO: 295 and the antisense strand comprises a modified nucleotide sequence according to SEQ ID NO: 199; (h) the sense strand comprises a modified nucleotide sequence according to SEQ ID NO: 296 and the antisense strand comprises a modified nucleotide sequence according to SEQ ID NO: 200; (i) the sense strand comprises a modified nucleotide sequence according to SEQ ID NO: 297 and the antisense strand comprises a modified nucleotide sequence according to SEQ ID NO: 201; (j) the sense strand comprises a modified nucleotide sequence according to SEQ ID NO: 298 and the antisense strand comprises a modified nucleotide sequence according to SEQ ID NO: 202; (k) the sense strand comprises a modified nucleotide sequence according to SEQ ID NO: 299 and the antisense strand comprises a modified nucleotide sequence according to SEQ ID NO: 203; (l) the sense strand comprises a modified nucleotide sequence according to SEQ ID NO: 300 and the antisense strand comprises a modified nucleotide sequence according to SEQ ID NO: 204; (m) the sense strand comprises a modified nucleotide sequence according to SEQ ID NO: 301 and the antisense strand comprises a modified nucleotide sequence according to SEQ ID NO: 205; (n) the sense strand comprises a modified nucleotide sequence according to SEQ ID NO: 302 and the antisense strand comprises a modified nucleotide sequence according to SEQ ID NO: 206; (o) the sense strand comprises a modified nucleotide sequence according to SEQ ID NO: 303 and the antisense strand comprises a modified nucleotide sequence according to SEQ ID NO: 207; (p) the sense strand comprises a modified nucleotide sequence according to SEQ ID NO: 304 and the antisense strand comprises a modified nucleotide sequence according to SEQ ID NO: 208; (q) the sense strand comprises a modified nucleotide sequence according to SEQ ID NO: 305 and the antisense strand comprises a modified nucleotide sequence according to SEQ ID NO: 209; (r) the sense strand comprises a modified nucleotide sequence according to SEQ ID NO: 306 and the antisense strand comprises a modified nucleotide sequence according to SEQ ID NO: 210; (s) the sense strand comprises a modified nucleotide sequence according to SEQ ID NO: 307 and the antisense strand comprises a modified nucleotide sequence according to SEQ ID NO: 211; (t) the sense strand comprises a modified nucleotide sequence according to SEQ ID NO: 308 and the antisense strand comprises a modified nucleotide sequence according to SEQ ID NO: 212; (u) the sense strand comprises a modified nucleotide sequence according to SEQ ID NO: 309 and the antisense strand comprises a modified nucleotide sequence according to SEQ ID NO: 213; (v) the sense strand comprises a modified nucleotide sequence according to SEQ ID NO: 310 and the antisense strand comprises a modified nucleotide sequence according to SEQ ID NO: 214; (w) the sense strand comprises a modified nucleotide sequence according to SEQ ID NO: 311 and the antisense strand comprises a modified nucleotide sequence according to SEQ ID NO: 215; (x) the sense strand comprises a modified nucleotide sequence according to SEQ ID NO: 312 and the antisense strand comprises a modified nucleotide sequence according to SEQ ID NO: 216; (y) the sense strand comprises a modified nucleotide sequence according to SEQ ID NO: 313 and the antisense strand comprises a modified nucleotide sequence according to SEQ ID NO: 217; (z) the sense strand comprises a modified nucleotide sequence according to SEQ ID NO: 314 and the antisense strand comprises a modified nucleotide sequence according to SEQ ID NO: 218; (aa) the sense strand comprises a modified nucleotide sequence according to SEQ ID NO: 315 and the antisense strand comprises a modified nucleotide sequence according to SEQ ID NO: 219; (bb) the sense strand comprises a modified nucleotide sequence according to SEQ ID NO: 316 and the antisense strand comprises a modified nucleotide sequence according to SEQ ID NO: 220; (cc) the sense strand comprises a modified nucleotide sequence according to SEQ ID NO: 317 and the antisense strand comprises a modified nucleotide sequence according to SEQ ID NO: 221; (dd) the sense strand comprises a modified nucleotide sequence according to SEQ ID NO: 318 and the antisense strand comprises a modified nucleotide sequence according to SEQ ID NO: 222; (ee) the sense strand comprises a modified nucleotide sequence according to SEQ ID NO: 319 and the antisense strand comprises a modified nucleotide sequence according to SEQ ID NO: 223; (ff) the sense strand comprises a modified nucleotide sequence according to SEQ ID NO: 320 and the antisense strand comprises a modified nucleotide sequence according to SEQ ID NO: 224; (gg) the sense strand comprises a modified nucleotide sequence according to SEQ ID NO: 321 and the antisense strand comprises a modified nucleotide sequence according to SEQ ID NO: 225; (hh) the sense strand comprises a modified nucleotide sequence according to SEQ ID NO: 322 and the antisense strand comprises a modified nucleotide sequence according to SEQ ID NO: 226; (ii) the sense strand comprises a modified nucleotide sequence according to SEQ ID NO: 323 and the antisense strand comprises a modified nucleotide sequence according to SEQ ID NO: 227; (jj) the sense strand comprises a modified nucleotide sequence according to SEQ ID NO: 324 and the antisense strand comprises a modified nucleotide sequence according to SEQ ID NO: 228; (kk) the sense strand comprises a modified nucleotide sequence according to SEQ ID NO: 325 and the antisense strand comprises a modified nucleotide sequence according to SEQ ID NO: 229; (ll) the sense strand comprises a modified nucleotide sequence according to SEQ ID NO: 326 and the antisense strand comprises a modified nucleotide sequence according to SEQ ID NO: 230; (mm) the sense strand comprises a modified nucleotide sequence according to SEQ ID NO: 327 and the antisense strand comprises a modified nucleotide sequence according to SEQ ID NO: 231; (nn) the sense strand comprises a modified nucleotide sequence according to SEQ ID NO: 328 and the antisense strand comprises a modified nucleotide sequence according to SEQ ID NO: 232; (oo) the sense strand comprises a modified nucleotide sequence according to SEQ ID NO: 329 and the antisense strand comprises a modified nucleotide sequence according to SEQ ID NO: 233; (pp) the sense strand comprises a modified nucleotide sequence according to SEQ ID NO: 330 and the antisense strand comprises a modified nucleotide sequence according to SEQ ID NO: 234; (qq) the sense strand comprises a modified nucleotide sequence according to SEQ ID NO: 331 and the antisense strand comprises a modified nucleotide sequence according to SEQ ID NO: 235; (rr) the sense strand comprises a modified nucleotide sequence according to SEQ ID NO: 332 and the antisense strand comprises a modified nucleotide sequence according to SEQ ID NO: 236; (ss) the sense strand comprises a modified nucleotide sequence according to SEQ ID NO: 333 and the antisense strand comprises a modified nucleotide sequence according to SEQ ID NO: 237; (tt) the sense strand comprises a modified nucleotide sequence according to SEQ ID NO: 334 and the antisense strand comprises a modified nucleotide sequence according to SEQ ID NO: 238; (uu) the sense strand comprises a modified nucleotide sequence according to SEQ ID NO: 335 and the antisense strand comprises a modified nucleotide sequence according to SEQ ID NO: 239; (vv) the sense strand comprises a modified nucleotide sequence according to SEQ ID NO: 336 and the antisense strand comprises a modified nucleotide sequence according to SEQ ID NO: 240; (ww) the sense strand comprises a modified nucleotide sequence according to SEQ ID NO: 337 and the antisense strand comprises a modified nucleotide sequence according to SEQ ID NO: 241; (xx) the sense strand comprises a modified nucleotide sequence according to SEQ ID NO: 338 and the antisense strand comprises a modified nucleotide sequence according to SEQ ID NO: 242; (yy) the sense strand comprises a modified nucleotide sequence according to SEQ ID NO: 339 and the antisense strand comprises a modified nucleotide sequence according to SEQ ID NO: 243; (zz) the sense strand comprises a modified nucleotide sequence according to SEQ ID NO: 340 and the antisense strand comprises a modified nucleotide sequence according to SEQ ID NO: 244; (aaa) the sense strand comprises a modified nucleotide sequence according to SEQ ID NO: 341 and the antisense strand comprises a modified nucleotide sequence according to SEQ ID NO: 245; (bbb) the sense strand comprises a modified nucleotide sequence according to SEQ ID NO: 342 and the antisense strand comprises a modified nucleotide sequence according to SEQ ID NO: 246; (ccc) the sense strand comprises a modified nucleotide sequence according to SEQ ID NO: 343 and the antisense strand comprises a modified nucleotide sequence according to SEQ ID NO: 247; (ddd) the sense strand comprises a modified nucleotide sequence according to SEQ ID NO: 344 and the antisense strand comprises a modified nucleotide sequence according to SEQ ID NO: 248; (eee) the sense strand comprises a modified nucleotide sequence according to SEQ ID NO: 345 and the antisense strand comprises a modified nucleotide sequence according to SEQ ID NO: 249; (fff) the sense strand comprises a modified nucleotide sequence according to SEQ ID NO: 346 and the antisense strand comprises a modified nucleotide sequence according to SEQ ID NO: 250; (ggg) the sense strand comprises a modified nucleotide sequence according to SEQ ID NO: 347 and the antisense strand comprises a modified nucleotide sequence according to SEQ ID NO: 251; (hhh) the sense strand comprises a modified nucleotide sequence according to SEQ ID NO: 348 and the antisense strand comprises a modified nucleotide sequence according to SEQ ID NO: 252; (iii) the sense strand comprises a modified nucleotide sequence according to SEQ ID NO: 349 and the antisense strand comprises a modified nucleotide sequence according to SEQ ID NO: 253; (jjj) the sense strand comprises a modified nucleotide sequence according to SEQ ID NO: 350 and the antisense strand comprises a modified nucleotide sequence according to SEQ ID NO: 254; (kkk) the sense strand comprises a modified nucleotide sequence according to SEQ ID NO: 351 and the antisense strand comprises a modified nucleotide sequence according to SEQ ID NO: 255; (lll) the sense strand comprises a modified nucleotide sequence according to SEQ ID NO: 352 and the antisense strand comprises a modified nucleotide sequence according to SEQ ID NO: 256; (mmm) the sense strand comprises a modified nucleotide sequence according to SEQ ID NO: 353 and the antisense strand comprises a modified nucleotide sequence according to SEQ ID NO: 257; (nnn) the sense strand comprises a modified nucleotide sequence according to SEQ ID NO: 354 and the antisense strand comprises a modified nucleotide sequence according to SEQ ID NO: 258; (ooo) the sense strand comprises a modified nucleotide sequence according to SEQ ID NO: 355 and the antisense strand comprises a modified nucleotide sequence according to SEQ ID NO: 259; (ppp) the sense strand comprises a modified nucleotide sequence according to SEQ ID NO: 356 and the antisense strand comprises a modified nucleotide sequence according to SEQ ID NO: 260; (qqq) the sense strand comprises a modified nucleotide sequence according to SEQ ID NO: 357 and the antisense strand comprises a modified nucleotide sequence according to SEQ ID NO: 261; (rrr) the sense strand comprises a modified nucleotide sequence according to SEQ ID NO: 358 and the antisense strand comprises a modified nucleotide sequence according to SEQ ID NO: 262; (sss) the sense strand comprises a modified nucleotide sequence according to SEQ ID NO: 359 and the antisense strand comprises a modified nucleotide sequence according to SEQ ID NO: 263; (ttt) the sense strand comprises a modified nucleotide sequence according to SEQ ID NO: 360 and the antisense strand comprises a modified nucleotide sequence according to SEQ ID NO: 264; (uuu) the sense strand comprises a modified nucleotide sequence according to SEQ ID NO: 361 and the antisense strand comprises a modified nucleotide sequence according to SEQ ID NO: 265; (vvv) the sense strand comprises a modified nucleotide sequence according to SEQ ID NO: 362 and the antisense strand comprises a modified nucleotide sequence according to SEQ ID NO: 266; (www) the sense strand comprises a modified nucleotide sequence according to SEQ ID NO: 363 and the antisense strand comprises a modified nucleotide sequence according to SEQ ID NO: 267; (xxx) the sense strand comprises a modified nucleotide sequence according to SEQ ID NO: 364 and the antisense strand comprises a modified nucleotide sequence according to SEQ ID NO: 268; (yyy) the sense strand comprises a modified nucleotide sequence according to SEQ ID NO: 365 and the antisense strand comprises a modified nucleotide sequence according to SEQ ID NO: 269; (zzz) the sense strand comprises a modified nucleotide sequence according to SEQ ID NO: 366 and the antisense strand comprises a modified nucleotide sequence according to SEQ ID NO: 270; (aaaa) the sense strand comprises a modified nucleotide sequence according to SEQ ID NO: 367 and the antisense strand comprises a modified nucleotide sequence according to SEQ ID NO: 271; (bbbb) the sense strand comprises a modified nucleotide sequence according to SEQ ID NO: 368 and the antisense strand comprises a modified nucleotide sequence according to SEQ ID NO: 272; (cccc) the sense strand comprises a modified nucleotide sequence according to SEQ ID NO: 369 and the antisense strand comprises a modified nucleotide sequence according to SEQ ID NO: 273; (dddd) the sense strand comprises a modified nucleotide sequence according to SEQ ID NO: 370 and the antisense strand comprises a modified nucleotide sequence according to SEQ ID NO: 274; (eeee) the sense strand comprises a modified nucleotide sequence according to SEQ ID NO: 371 and the antisense strand comprises a modified nucleotide sequence according to SEQ ID NO: 275; (ffff) the sense strand comprises a modified nucleotide sequence according to SEQ ID NO: 372 and the antisense strand comprises a modified nucleotide sequence according to SEQ ID NO: 276; (gggg) the sense strand comprises a modified nucleotide sequence according to SEQ ID NO: 373 and the antisense strand comprises a modified nucleotide sequence according to SEQ ID NO: 277; (hhhh) the sense strand comprises a modified nucleotide sequence according to SEQ ID NO: 374 and the antisense strand comprises a modified nucleotide sequence according to SEQ ID NO: 278; (iiii) the sense strand comprises a modified nucleotide sequence according to SEQ ID NO: 375 and the antisense strand comprises a modified nucleotide sequence according to SEQ ID NO: 279; (jjjj) the sense strand comprises a modified nucleotide sequence according to SEQ ID NO: 376 and the antisense strand comprises a modified nucleotide sequence according to SEQ ID NO: 280; (kkkk) the sense strand comprises a modified nucleotide sequence according to SEQ ID NO: 377 and the antisense strand comprises a modified nucleotide sequence according to SEQ ID NO: 281; (llll) the sense strand comprises a modified nucleotide sequence according to SEQ ID NO: 378 and the antisense strand comprises a modified nucleotide sequence according to SEQ ID NO: 282; (mmmm) the sense strand comprises a modified nucleotide sequence according to SEQ ID NO: 379 and the antisense strand comprises a modified nucleotide sequence according to SEQ ID NO: 283; (nnnn) the sense strand comprises a modified nucleotide sequence according to SEQ ID NO: 380 and the antisense strand comprises a modified nucleotide sequence according to SEQ ID NO: 284; (oooo) the sense strand comprises a modified nucleotide sequence according to SEQ ID NO: 381 and the antisense strand comprises a modified nucleotide sequence according to SEQ ID NO: 285; (pppp) the sense strand comprises a modified nucleotide sequence according to SEQ ID NO: 382 and the antisense strand comprises a modified nucleotide sequence according to SEQ ID NO: 286; (qqqq) the sense strand comprises a modified nucleotide sequence according to SEQ ID NO: 383 and the antisense strand comprises a modified nucleotide sequence according to SEQ ID NO: 287; (rrrr) the sense strand comprises a modified nucleotide sequence according to SEQ ID NO: 384 and the antisense strand comprises a modified nucleotide sequence according to SEQ ID NO: 288; (ssss) the sense strand comprises a modified nucleobase sequence according to SEQ ID NO: 604 and the antisense strand comprises a modified nucleobase sequence according to SEQ ID NO: 531; (tttt) the sense strand comprises a modified nucleobase sequence according to SEQ ID NO: 605 and the antisense strand comprises a modified nucleobase sequence according to SEQ ID NO: 532; (uuuu) the sense strand comprises a modified nucleobase sequence according to SEQ ID NO: 606 and the antisense strand comprises a modified nucleobase sequence according to SEQ ID NO: 533; (vvvv) the sense strand comprises a modified nucleobase sequence according to SEQ ID NO: 607 and the antisense strand comprises a modified nucleobase sequence according to SEQ ID NO: 534; (wwww) the sense strand comprises a modified nucleobase sequence according to SEQ ID NO: 608 and the antisense strand comprises a modified nucleobase sequence according to SEQ ID NO: 535; (xxxx) the sense strand comprises a modified nucleobase sequence according to SEQ ID NO: 609 and the antisense strand comprises a modified nucleobase sequence according to SEQ ID NO: 536; (yyyy) the sense strand comprises a modified nucleobase sequence according to SEQ ID NO: 610 and the antisense strand comprises a modified nucleobase sequence according to SEQ ID NO: 537; (zzzz) the sense strand comprises a modified nucleobase sequence according to SEQ ID NO: 611 and the antisense strand comprises a modified nucleobase sequence according to SEQ ID NO: 538; (aaaaa) the sense strand comprises a modified nucleobase sequence according to SEQ ID NO: 612 and the antisense strand comprises a modified nucleobase sequence according to SEQ ID NO: 539; (bbbbb) the sense strand comprises a modified nucleobase sequence according to SEQ ID NO: 613 and the antisense strand comprises a modified nucleobase sequence according to SEQ ID NO: 540; (ccccc) the sense strand comprises a modified nucleobase sequence according to SEQ ID NO: 614 and the antisense strand comprises a modified nucleobase sequence according to SEQ ID NO: 541; (ddddd) the sense strand comprises a modified nucleobase sequence according to SEQ ID NO: 615 and the antisense strand comprises a modified nucleobase sequence according to SEQ ID NO: 542; (eeeee) the sense strand comprises a modified nucleobase sequence according to SEQ ID NO: 616 and the antisense strand comprises a modified nucleobase sequence according to SEQ ID NO: 543; (fffff) the sense strand comprises a modified nucleobase sequence according to SEQ ID NO: 617 and the antisense strand comprises a modified nucleobase sequence according to SEQ ID NO: 544; (ggggg) the sense strand comprises a modified nucleobase sequence according to SEQ ID NO: 618 and the antisense strand comprises a modified nucleobase sequence according to SEQ ID NO: 545; (hhhhh) the sense strand comprises a modified nucleobase sequence according to SEQ ID NO: 619 and the antisense strand comprises a modified nucleobase sequence according to SEQ ID NO: 546; (iiiii) the sense strand comprises a modified nucleobase sequence according to SEQ ID NO: 620 and the antisense strand comprises a modified nucleobase sequence according to SEQ ID NO: 547; (jjjjj) the sense strand comprises a modified nucleobase sequence according to SEQ ID NO: 621 and the antisense strand comprises a modified nucleobase sequence according to SEQ ID NO: 548; (kkkkk) the sense strand comprises a modified nucleobase sequence according to SEQ ID NO: 622 and the antisense strand comprises a modified nucleobase sequence according to SEQ ID NO: 549; (lllll) the sense strand comprises a modified nucleobase sequence according to SEQ ID NO: 623 and the antisense strand comprises a modified nucleobase sequence according to SEQ ID NO: 550; (mmmmm) the sense strand comprises a modified nucleobase sequence according to SEQ ID NO: 624 and the antisense strand comprises a modified nucleobase sequence according to SEQ ID NO: 551; (nnnnn) the sense strand comprises a modified nucleobase sequence according to SEQ ID NO: 625 and the antisense strand comprises a modified nucleobase sequence according to SEQ ID NO: 552; (ooooo) the sense strand comprises a modified nucleobase sequence according to SEQ ID NO: 626 and the antisense strand comprises a modified nucleobase sequence according to SEQ ID NO: 553; (ppppp) the sense strand comprises a modified nucleobase sequence according to SEQ ID NO: 627 and the antisense strand comprises a modified nucleobase sequence according to SEQ ID NO: 554; (qqqqq) the sense strand comprises a modified nucleobase sequence according to SEQ ID NO: 628 and the antisense strand comprises a modified nucleobase sequence according to SEQ ID NO: 555; (rrrrr) the sense strand comprises a modified nucleobase sequence according to SEQ ID NO: 629 and the antisense strand comprises a modified nucleobase sequence according to SEQ ID NO: 556; (sssss) the sense strand comprises a modified nucleobase sequence according to SEQ ID NO: 630 and the antisense strand comprises a modified nucleobase sequence according to SEQ ID NO: 557; (ttttt) the sense strand comprises a modified nucleobase sequence according to SEQ ID NO: 631 and the antisense strand comprises a modified nucleobase sequence according to SEQ ID NO: 558; (uuuuu) the sense strand comprises a modified nucleobase sequence according to SEQ ID NO: 632 and the antisense strand comprises a modified nucleobase sequence according to SEQ ID NO: 559; (vvvvv) the sense strand comprises a modified nucleobase sequence according to SEQ ID NO: 633 and the antisense strand comprises a modified nucleobase sequence according to SEQ ID NO: 560; (wwwww) the sense strand comprises a modified nucleobase sequence according to SEQ ID NO: 634 and the antisense strand comprises a modified nucleobase sequence according to SEQ ID NO: 561; (xxxxx) the sense strand comprises a modified nucleobase sequence according to SEQ ID NO: 635 and the antisense strand comprises a modified nucleobase sequence according to SEQ ID NO: 562; (yyyyy) the sense strand comprises a modified nucleobase sequence according to SEQ ID NO: 636 and the antisense strand comprises a modified nucleobase sequence according to SEQ ID NO: 563; (zzzzz) the sense strand comprises a modified nucleobase sequence according to SEQ ID NO: 637 and the antisense strand comprises a modified nucleobase sequence according to SEQ ID NO: 564; (aaaaaa) the sense strand comprises a modified nucleobase sequence according to SEQ ID NO: 638 and the antisense strand comprises a modified nucleobase sequence according to SEQ ID NO: 565; (bbbbbb) the sense strand comprises a modified nucleobase sequence according to SEQ ID NO: 639 and the antisense strand comprises a modified nucleobase sequence according to SEQ ID NO: 566; (cccccc) the sense strand comprises a modified nucleobase sequence according to SEQ ID NO: 640 and the antisense strand comprises a modified nucleobase sequence according to SEQ ID NO: 567; (dddddd) the sense strand comprises a modified nucleobase sequence according to SEQ ID NO: 641 and the antisense strand comprises a modified nucleobase sequence according to SEQ ID NO: 568; (eeeeee) the sense strand comprises a modified nucleobase sequence according to SEQ ID NO: 642 and the antisense strand comprises a modified nucleobase sequence according to SEQ ID NO: 569; (ffffff) the sense strand comprises a modified nucleobase sequence according to SEQ ID NO: 643 and the antisense strand comprises a modified nucleobase sequence according to SEQ ID NO: 570; (gggggg) the sense strand comprises a modified nucleobase sequence according to SEQ ID NO: 644 and the antisense strand comprises a modified nucleobase sequence according to SEQ ID NO: 571; (hhhhhh) the sense strand comprises a modified nucleobase sequence according to SEQ ID NO: 645 and the antisense strand comprises a modified nucleobase sequence according to SEQ ID NO: 572; (iiiiii) the sense strand comprises a modified nucleobase sequence according to SEQ ID NO: 646 and the antisense strand comprises a modified nucleobase sequence according to SEQ ID NO: 573; (jjjjjj) the sense strand comprises a modified nucleobase sequence according to SEQ ID NO: 647 and the antisense strand comprises a modified nucleobase sequence according to SEQ ID NO: 574; (kkkkkk) the sense strand comprises a modified nucleobase sequence according to SEQ ID NO: 648 and the antisense strand comprises a modified nucleobase sequence according to SEQ ID NO: 575; (llllll) the sense strand comprises a modified nucleobase sequence according to SEQ ID NO: 649 and the antisense strand comprises a modified nucleobase sequence according to SEQ ID NO: 576; (mmmmmm) the sense strand comprises a modified nucleobase sequence according to SEQ ID NO: 650 and the antisense strand comprises a modified nucleobase sequence according to SEQ ID NO: 577; (nnnnnn) the sense strand comprises a modified nucleobase sequence according to SEQ ID NO: 651 and the antisense strand comprises a modified nucleobase sequence according to SEQ ID NO: 578; (oooooo) the sense strand comprises a modified nucleobase sequence according to SEQ ID NO: 652 and the antisense strand comprises a modified nucleobase sequence according to SEQ ID NO: 579; (pppppp) the sense strand comprises a modified nucleobase sequence according to SEQ ID NO: 653 and the antisense strand comprises a modified nucleobase sequence according to SEQ ID NO: 580; (qqqqqq) the sense strand comprises a modified nucleobase sequence according to SEQ ID NO: 654 and the antisense strand comprises a modified nucleobase sequence according to SEQ ID NO: 581; (rrrrrr) the sense strand comprises a modified nucleobase sequence according to SEQ ID NO: 655 and the antisense strand comprises a modified nucleobase sequence according to SEQ ID NO: 582; (ssssss) the sense strand comprises a modified nucleobase sequence according to SEQ ID NO: 656 and the antisense strand comprises a modified nucleobase sequence according to SEQ ID NO: 583; (tttttt) the sense strand comprises a modified nucleobase sequence according to SEQ ID NO: 657 and the antisense strand comprises a modified nucleobase sequence according to SEQ ID NO: 584; (uuuuuu) the sense strand comprises a modified nucleobase sequence according to SEQ ID NO: 658 and the antisense strand comprises a modified nucleobase sequence according to SEQ ID NO: 585; (vvvvvv) the sense strand comprises a modified nucleobase sequence according to SEQ ID NO: 659 and the antisense strand comprises a modified nucleobase sequence according to SEQ ID NO: 586; (wwwwww) the sense strand comprises a modified nucleobase sequence according to SEQ ID NO: 660 and the antisense strand comprises a modified nucleobase sequence according to SEQ ID NO: 587; (xxxxxx) the sense strand comprises a modified nucleobase sequence according to SEQ ID NO: 661 and the antisense strand comprises a modified nucleobase sequence according to SEQ ID NO: 588; (yyyyyy) the sense strand comprises a modified nucleobase sequence according to SEQ ID NO: 662 and the antisense strand comprises a modified nucleobase sequence according to SEQ ID NO: 589; (zzzzzz) the sense strand comprises a modified nucleobase sequence according to SEQ ID NO: 663 and the antisense strand comprises a modified nucleobase sequence according to SEQ ID NO: 590; (aaaaaaa) the sense strand comprises a modified nucleobase sequence according to SEQ ID NO: 664 and the antisense strand comprises a modified nucleobase sequence according to SEQ ID NO: 591; (bbbbbbb) the sense strand comprises a modified nucleobase sequence according to SEQ ID NO: 665 and the antisense strand comprises a modified nucleobase sequence according to SEQ ID NO: 592; (ccccccc) the sense strand comprises a modified nucleobase sequence according to SEQ ID NO: 666 and the antisense strand comprises a modified nucleobase sequence according to SEQ ID NO: 593; (ddddddd) the sense strand comprises a modified nucleobase sequence according to SEQ ID NO: 667 and the antisense strand comprises a modified nucleobase sequence according to SEQ ID NO: 594; (eeeeeee) the sense strand comprises a modified nucleobase sequence according to SEQ ID NO: 668 and the antisense strand comprises a modified nucleobase sequence according to SEQ ID NO: 595; (fffffff) the sense strand comprises a modified nucleobase sequence according to SEQ ID NO: 669 and the antisense strand comprises a modified nucleobase sequence according to SEQ ID NO: 596; (ggggggg) the sense strand comprises a modified nucleobase sequence according to SEQ ID NO: 670 and the antisense strand comprises a modified nucleobase sequence according to SEQ ID NO: 597; (hhhhhhh) the sense strand comprises a modified nucleobase sequence according to SEQ ID NO: 671 and the antisense strand comprises a modified nucleobase sequence according to SEQ ID NO: 598; (iiiiiii) the sense strand comprises a modified nucleobase sequence according to SEQ ID NO: 672 and the antisense strand comprises a modified nucleobase sequence according to SEQ ID NO: 599; (jjjjjjj) the sense strand comprises a modified nucleobase sequence according to SEQ ID NO: 673 and the antisense strand comprises a modified nucleobase sequence according to SEQ ID NO: 600; (kkkkkkk) the sense strand comprises a modified nucleobase sequence according to SEQ ID NO: 674 and the antisense strand comprises a modified nucleobase sequence according to SEQ ID NO: 601; (lllllll) the sense strand comprises a modified nucleobase sequence according to SEQ ID NO: 675 and the antisense strand comprises a modified nucleobase sequence according to SEQ ID NO: 602; (mmmmmmm) the sense strand comprises a modified nucleobase sequence according to SEQ ID NO: 676 and the antisense strand comprises a modified nucleobase sequence according to SEQ ID NO: 603; (nnnnnnn) the sense strand comprises a modified nucleobase sequence according to SEQ ID NO: 713 and the antisense strand comprises a modified nucleobase sequence according to SEQ ID NO: 701; (ooooooo) the sense strand comprises a modified nucleobase sequence according to SEQ ID NO: 714 and the antisense strand comprises a modified nucleobase sequence according to SEQ ID NO: 702; (ppppppp) the sense strand comprises a modified nucleobase sequence according to SEQ ID NO: 715 and the antisense strand comprises a modified nucleobase sequence according to SEQ ID NO: 703; (qqqqqqq) the sense strand comprises a modified nucleobase sequence according to SEQ ID NO: 716 and the antisense strand comprises a modified nucleobase sequence according to SEQ ID NO: 704; (rrrrrrr) the sense strand comprises a modified nucleobase sequence according to SEQ ID NO: 717 and the antisense strand comprises a modified nucleobase sequence according to SEQ ID NO: 705; (sssssss) the sense strand comprises a modified nucleobase sequence according to SEQ ID NO: 718 and the antisense strand comprises a modified nucleobase sequence according to SEQ ID NO: 706; (ttttttt) the sense strand comprises a modified nucleobase sequence according to SEQ ID NO: 719 and the antisense strand comprises a modified nucleobase sequence according to SEQ ID NO: 707; (uuuuuuu) the sense strand comprises a modified nucleobase sequence according to SEQ ID NO: 720 and the antisense strand comprises a modified nucleobase sequence according to SEQ ID NO: 708; (vvvvvvv) the sense strand comprises a modified nucleobase sequence according to SEQ ID NO: 721 and the antisense strand comprises a modified nucleobase sequence according to SEQ ID NO: 709; (wwwwwww) the sense strand comprises a modified nucleobase sequence according to SEQ ID NO: 722 and the antisense strand comprises a modified nucleobase sequence according to SEQ ID NO: 710; (xxxxxxx) the sense strand comprises a modified nucleobase sequence according to SEQ ID NO: 723 and the antisense strand comprises a modified nucleobase sequence according to SEQ ID NO: 711; (yyyyyyy) the sense strand comprises a modified nucleobase sequence according to SEQ ID NO: 724 and the antisense strand comprises a modified nucleobase sequence according to SEQ ID NO: 712; (aaaaaaaa) the sense strand comprises a modified nucleobase sequence according to SEQ ID NO: 726 and the antisense strand comprises a modified nucleobase sequence according to SEQ ID NO: 603; (bbbbbbbb) the sense strand comprises a modified nucleobase sequence according to SEQ ID NO: 727 and the antisense strand comprises a modified nucleobase sequence according to SEQ ID NO: 596; (cccccccc) the sense strand comprises a modified nucleobase sequence according to SEQ ID NO: 728 and the antisense strand comprises a modified nucleobase sequence according to SEQ ID NO: 703; (dddddddd) the sense strand comprises a modified nucleobase sequence according to SEQ ID NO: 729 and the antisense strand comprises a modified nucleobase sequence according to SEQ ID NO: 701; (eeeeeeee) the sense strand comprises a modified nucleobase sequence according to SEQ ID NO: 730 and the antisense strand comprises a modified nucleobase sequence according to SEQ ID NO: 595; or (ffffffff) the sense strand comprises a modified nucleobase sequence according to SEQ ID NO: 731 and the antisense strand comprises a modified nucleobase sequence according to SEQ ID NO: 704.

In some implementations, (a) the sense strand comprises a modified nucleobase sequence according to SEQ ID NO: 676 and the antisense strand comprises a modified nucleobase sequence according to SEQ ID NO: 603; (b) the sense strand comprises a modified nucleobase sequence according to SEQ ID NO: 669 and the antisense strand comprises a modified nucleobase sequence according to SEQ ID NO: 596; (c) the sense strand comprises a modified nucleobase sequence according to SEQ ID NO: 715 and the antisense strand comprises a modified nucleobase sequence according to SEQ ID NO: 703; (d) the sense strand comprises a modified nucleobase sequence according to SEQ ID NO: 713 and the antisense strand comprises a modified nucleobase sequence according to SEQ ID NO: 701; (e) the sense strand comprises a modified nucleobase sequence according to SEQ ID NO: 668 and the antisense strand comprises a modified nucleobase sequence according to SEQ ID NO: 595; (f) the sense strand comprises a modified nucleobase sequence according to SEQ ID NO: 716 and the antisense strand comprises a modified nucleobase sequence according to SEQ ID NO: 704; (g) the sense strand comprises a modified nucleobase sequence according to SEQ ID NO: 726 and the antisense strand comprises a modified nucleobase sequence according to SEQ ID NO: 603; (h) the sense strand comprises a modified nucleobase sequence according to SEQ ID NO: 727 and the antisense strand comprises a modified nucleobase sequence according to SEQ ID NO: 596; (i) the sense strand comprises a modified nucleobase sequence according to SEQ ID NO: 728 and the antisense strand comprises a modified nucleobase sequence according to SEQ ID NO: 703; (j) the sense strand comprises a modified nucleobase sequence according to SEQ ID NO: 729 and the antisense strand comprises a modified nucleobase sequence according to SEQ ID NO: 701; (k) the sense strand comprises a modified nucleobase sequence according to SEQ ID NO: 730 and the antisense strand comprises a modified nucleobase sequence according to SEQ ID NO: 595; or (l) the sense strand comprises a modified nucleobase sequence according to SEQ ID NO: 731 and the antisense strand comprises a modified nucleobase sequence according to SEQ ID NO: 704.

In some implementations, the RNAi agent comprises a targeting ligand comprising a structure according to Formula I:

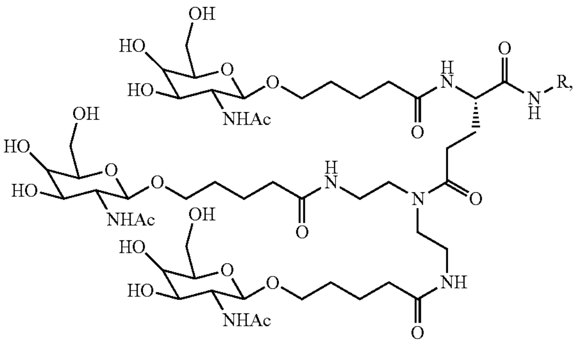

wherein R is a linker conjugated to the wherein the targeting ligand is conjugated to 3' end of the sense strand, wherein R comprises a structure according to Formula III:

Formula III

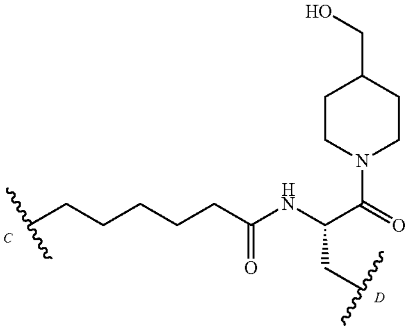

and wherein connection point C of Formula III is conjugated to Formula I, and connection point D of Formula III is conjugated to the 3' end of the sense strand.

In some implementations, the sense strand comprises a 3' overhang of 1-5 nucleotides in length. In some implementations, the sense strand comprises a 5' overhang of 1-5 nucleotides in length.

In some implementations, the antisense strand comprises a 3' overhang of 1-5 nucleotides in length. In some implementations, the antisense strand comprises a 5' overhang of 1-5 nucleotides in length.

In some implementations, the sense strand or the antisense strand comprises at least one modified nucleotide or at least one modified internucleoside linkage. In some implementations, the sense strand and or the antisense strand comprises a modified internucleoside linkage at a first, second, penultimate, or final internucleoside linkage position. In some implementations, the at least one modified nucleotide or at least one modified internucleoside linkage comprises a 2'-O-methyl modified nucleotide, a nucleotide comprising a 5'-phosphorothioate group, a 2'-deoxy-2'-fluoro modified nucleotide, a 2'-deoxy-modified nucleotide, a locked nucleotide, an abasic nucleotide, deoxythymidine, an inverted deoxythymidine, a 2'-amino-modified nucleotide, a 2'-alkyl-modified nucleotide, a morpholino nucleotide, a phosphoramidate, or a non-natural base comprising nucleotide.

In some implementations, the targeting ligand is conjugated to the sense strand. In some implementations, the targeting ligand is conjugated to the 3' end of the sense strand. In some implementations, the targeting ligand is conjugated to the 5' end of the sense strand.

In some implementations, the targeting ligand is conjugated to the antisense strand. In some implementations, the targeting ligand is conjugated to the 3' end of the antisense strand. In some implementations, the targeting ligand is conjugated to the 5' end of the antisense strand.

In some implementations, the targeting ligand comprises a galactose trimer. In some implementations, the targeting ligand comprises N-acetylgalactosamine (GalNac).

In some implementations, the targeting ligand comprises a structure according to Formula I:

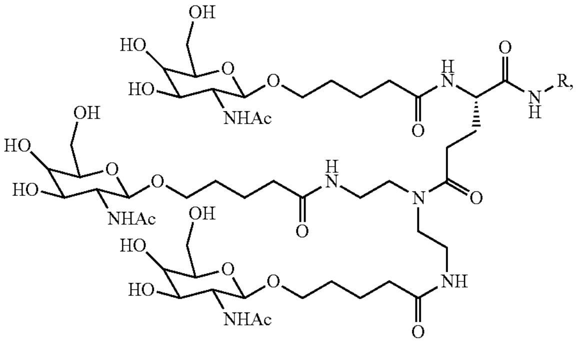

wherein R is: (i) the sense strand or the antisense strand; or (ii) a linker conjugated to the sense strand or the antisense strand. In some implementations, R is a linker conjugated to the sense strand or the antisense strand having a structure according to Formula III:

Formula III

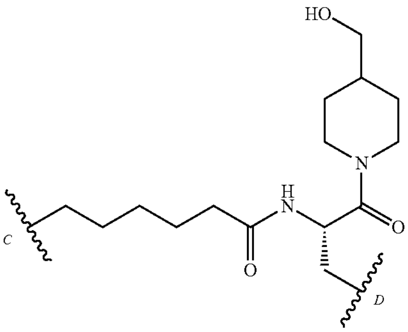

wherein: (i) connection point C of Formula III is conjugated to Formula I, and connection point D of Formula III is conjugated to the sense strand or the antisense strand; or (ii) connection point C of Formula III is conjugated to Formula I, and connection point D of Formula III is conjugated to a phosphate group which is conjugated to the sense strand or the antisense strand. In some implementations, Formula III or the phosphate group is conjugated to the 3' end or 5' end of the sense strand or the antisense strand. In some implementations, Formula III or the phosphate group is conjugated to an internal nucleotide or nucleoside base of the sense strand or the antisense strand.

In some implementations, the RNAi agent comprises a targeting ligand and linker according to Formula V:

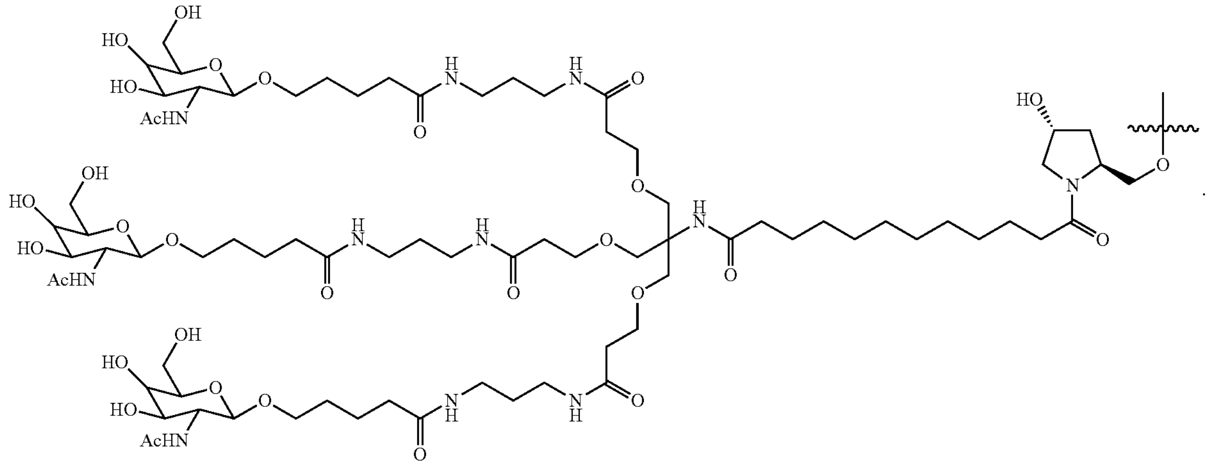 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

In some implementations, the RNAi agent is an siRNA molecule. In some implementations, the RNAi agent is an shRNA molecule.

Also described herein is a modified oligonucleotide consisting of 12 to 30 or 12 to 50 linked nucleosides, wherein the modified oligonucleotide has a nucleobase sequence comprising at least 12, at least 13, at least 14, at least 15, at least 16, at least 17, at least 18, at least 19, at least 20, at least 21, at least 22, at least 23, at least 24, or at least 25 contiguous nucleobases complementary to an equal length portion of SEQ ID NO: 725, and wherein the modified oligonucleotide comprises at least one synthetically modified internucleoside linkage or at least one synthetically modified sugar-phosphate backbone.

In some implementations, the modified oligonucleotide comprises a synthetically modified internucleoside linkage at a first, second, penultimate, or final internucleoside linkage position.

In some implementations, the modified oligonucleotide comprises a 2'-O-methyl modified nucleotide, a nucleotide comprising a 5'-phosphorothioate group, a 2'-deoxy-2'-fluoro modified nucleotide, a 2'-deoxy-modified nucleotide, a locked nucleotide, an abasic nucleotide, deoxythymidine, an inverted deoxythymidine, a 2'-amino-modified nucleotide, a 2'-alkyl-modified nucleotide, a morpholino nucleotide, a phosphoramidate, or a non-natural base comprising nucleotide.

In some implementations, the modified oligonucleotide or a subsequence thereof differs by 0, 1, 2, 3, or 4 nucleotides from an equal length portion of any one of SEQ ID NOS: 193-288, 531-603, and 701-712, wherein the subsequence is at least 14, 15, 16, 17, 18, 19, 20, or 21 bases in length.

In some implementations, the modified oligonucleotide comprises, in order, nucleotides 2-23 of any one of SEQ ID NOS: 193-288, 531-603, and 701-712.

In some implementations, the modified oligonucleotide comprises a modified nucleotide sequence according to any one of SEQ ID NOS: 193-288, 531-603, and 701-712.

In some implementations, the modified oligonucleotide is conjugated to a targeting ligand that targets a hepatocyte. In some implementations, the modified oligonucleotide is conjugated to the targeting ligand conjugated to its 3' end. In some implementations, the modified oligonucleotide is conjugated to the targeting ligand conjugated to its 5' end. In some implementations, the targeting ligand comprises a galactose trimer. In some implementations, the targeting ligand comprises N-acetylgalactosamine (GalNac).

In some implementations, the targeting ligand comprises a structure according to Formula I:

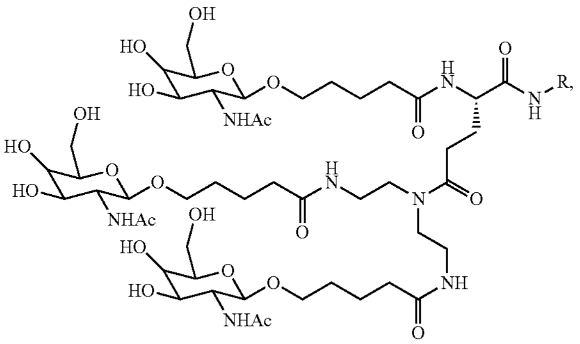

wherein R is:

(i) the modified oligonucleotide; or (ii) a linker conjugated to the modified oligonucleotide. In some implementations, R is a linker conjugated to the modified oligonucleotide having a structure according to Formula III:

Formula III

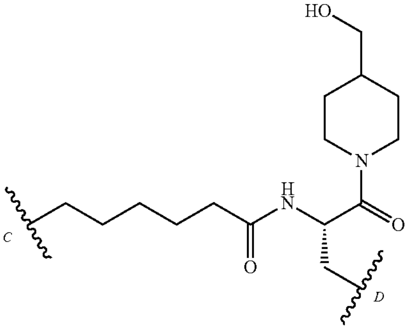

wherein:

(i) connection point C of Formula III is conjugated to Formula I, and connection point D of Formula III is conjugated to the modified oligonucleotide; or (ii) connection point C of Formula III is conjugated to Formula I, and connection point D of Formula III is conjugated to a phosphate group which is conjugated to the modified oligonucleotide.

In some implementations, Formula III or the phosphate group is conjugated to 3' end or 5' end of the modified oligonucleotide. In some implementations, Formula III or the phosphate group is conjugated to an internal nucleotide or nucleoside base of the modified oligonucleotide.

In some implementations, the modified oligonucleotide comprises a targeting ligand and linker according to Formula V:

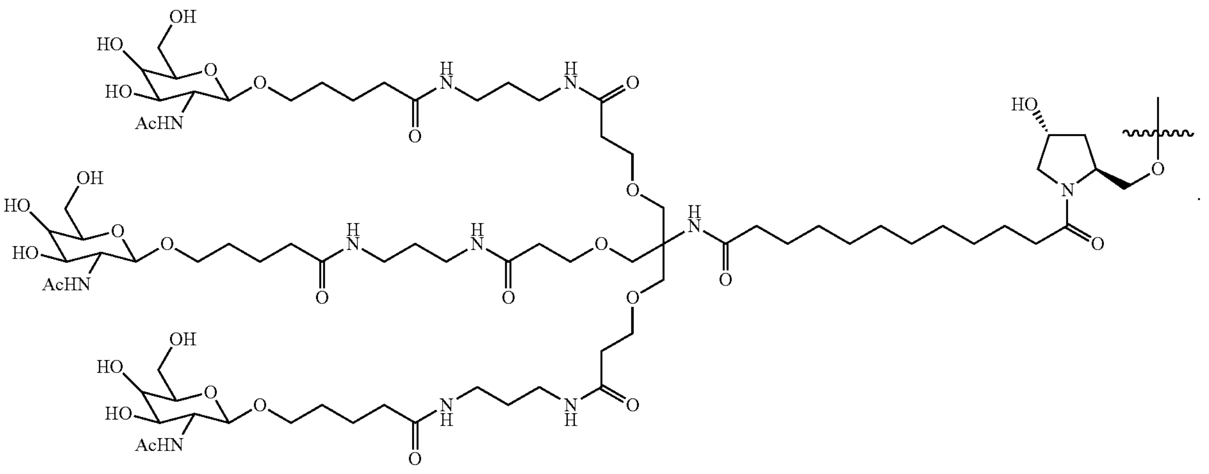 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

In some implementations, the modified oligonucleotide is an siRNA molecule. In some implementations, the modified oligonucleotide is an shRNA molecule.

Further described herein is an oligomeric duplex comprising (a) a first modified oligonucleotide consisting of 12 to 30 or 12 to 50 linked nucleosides, wherein a nucleobase sequence of the first modified oligonucleotide comprises at least 12, at least 13, at least 14, at least 15, at least 16, at least 17, at least 18, at least 19, at least 20, at least 21, at least 22, at least 23, at least 24, or at least 25 contiguous nucleobases complementary to an equal length portion of SEQ ID NO: 725; and (b) a second modified oligonucleotide consisting of 12 to 30 or 12 to 50 linked nucleosides, wherein a nucleobase sequence of the second modified oligonucleotide comprises a complementary region of at least 8 nucleobases that is at least 90% complementary to the nucleobase sequence of an equal length portion of the first modified oligonucleotide. In some implementations, the first modified oligonucleotide and/or second modified oligonucleotide comprises at least one synthetically modified internucleoside linkage or at least one synthetically modified sugar-phosphate backbone.

In some implementations, the first modified oligonucleotide and/or the second comprises a 2'-O-methyl modified nucleotide, a nucleotide comprising a 5'-phosphorothioate group, a 2'-deoxy-2'-fluoro modified nucleotide, a 2'-deoxy-modified nucleotide, a locked nucleotide, an abasic nucleotide, deoxythymidine, an inverted deoxythymidine, a 2'-amino-modified nucleotide, a 2'-alkyl-modified nucleotide, a morpholino nucleotide, a phosphoramidate, or a non-natural base comprising nucleotide.

In some implementations, the first modified oligonucleotide or a subsequence thereof differs by 0, 1, 2, 3, or 4 nucleotides from an equal length portion of any one of SEQ ID NOS: 193-288, 531-603, and 701-712, wherein the subsequence is at least 14, 15, 16, 17, 18, 19, 20, or 21 bases in length. In some implementations, the first modified oligonucleotide comprises, in order, nucleotides 2-23 of any one of SEQ ID NOS: 193-288, 531-603, and 701-712. In some implementations, the first modified oligonucleotide comprises a modified nucleotide sequence according to any one of SEQ ID NOS: 193-288, 531-603, and 701-712. In some implementations, the first modified oligonucleotide comprises a modified nucleotide sequence according to any one of SEQ ID NOS: 595, 596, 603, 701, 703, and 704.

In some implementations, the second modified oligonucleotide or a subsequence thereof differs by 0, 1, 2, 3, or 4 nucleotides from an equal length portion of any one of SEQ ID NOS: 289-384, 604-676, 713-724, and 726-731, wherein the subsequence is at least 14, 15, 16, 17, 18, 19, 20, or 21 bases in length. In some implementations, the second modified oligonucleotide comprises, in order, nucleotides 1-22 of any one of SEQ ID NOS: 289-384, 604-676, 713-724, and 726-731. In some implementations, the second modified oligonucleotide comprises a modified nucleotide sequence according to any one of SEQ ID NOS: 289-384, 604-676, 713-724, and 726-731. In some implementations, the second modified oligonucleotide comprises a modified nucleotide sequence according to any one of SEQ ID NOS: 522, 523, 530, 689, 691, 692, and 726-731.

In some implementations, (a) the second modified oligonucleotide comprises a modified nucleotide sequence according to SEQ ID NO: 289 and the first modified oligonucleotide comprises a modified nucleotide sequence according to SEQ ID NO: 193; (b) the second modified oligonucleotide comprises a modified nucleotide sequence according to SEQ ID NO: 290 and the first modified oligonucleotide comprises a modified nucleotide sequence according to SEQ ID NO: 194; (c) the second modified oligonucleotide comprises a modified nucleotide sequence according to SEQ ID NO: 291 and the first modified oligonucleotide comprises a modified nucleotide sequence according to SEQ ID NO: 195; (d) the second modified oligonucleotide comprises a modified nucleotide sequence according to SEQ ID NO: 292 and the first modified oligonucleotide comprises a modified nucleotide sequence according to SEQ ID NO: 196; (e) the second modified oligonucleotide comprises a modified nucleotide sequence according to SEQ ID NO: 293 and the first modified oligonucleotide comprises a modified nucleotide sequence according to SEQ ID NO: 197; (f) the second modified oligonucleotide comprises a modified nucleotide sequence according to SEQ ID NO: 294 and the first modified oligonucleotide comprises a modified nucleotide sequence according to SEQ ID NO: 198; (g) the second modified oligonucleotide comprises a modified nucleotide sequence according to SEQ ID NO: 295 and the first modified oligonucleotide comprises a modified nucleotide sequence according to SEQ ID NO: 199; (h) the second modified oligonucleotide comprises a modified nucleotide sequence according to SEQ ID NO: 296 and the first modified oligonucleotide comprises a modified nucleotide sequence according to SEQ ID NO: 200; (i) the second modified oligonucleotide comprises a modified nucleotide sequence according to SEQ ID NO: 297 and the first modified oligonucleotide comprises a modified nucleotide sequence according to SEQ ID NO: 201; (j) the second modified oligonucleotide comprises a modified nucleotide sequence according to SEQ ID NO: 298 and the first modified oligonucleotide comprises a modified nucleotide sequence according to SEQ ID NO: 202; (k) the second modified oligonucleotide comprises a modified nucleotide sequence according to SEQ ID NO: 299 and the first modified oligonucleotide comprises a modified nucleotide sequence according to SEQ ID NO: 203; (l) the second modified oligonucleotide comprises a modified nucleotide sequence according to SEQ ID NO: 300 and the first modified oligonucleotide comprises a modified nucleotide sequence according to SEQ ID NO: 204; (m) the second modified oligonucleotide comprises a modified nucleotide sequence according to SEQ ID NO: 301 and the first modified oligonucleotide comprises a modified nucleotide sequence according to SEQ ID NO: 205; (n) the second modified oligonucleotide comprises a modified nucleotide sequence according to SEQ ID NO: 302 and the first modified oligonucleotide comprises a modified nucleotide sequence according to SEQ ID NO: 206; (o) the second modified oligonucleotide comprises a modified nucleotide sequence according to SEQ ID NO: 303 and the first modified oligonucleotide comprises a modified nucleotide sequence according to SEQ ID NO: 207; (p) the second modified oligonucleotide comprises a modified nucleotide sequence according to SEQ ID NO: 304 and the first modified oligonucleotide comprises a modified nucleotide sequence according to SEQ ID NO: 208; (q) the second modified oligonucleotide comprises a modified nucleotide sequence according to SEQ ID NO: 305 and the first modified oligonucleotide comprises a modified nucleotide sequence according to SEQ ID NO: 209; (r) the second modified oligonucleotide comprises a modified nucleotide sequence according to SEQ ID NO: 306 and the first modified oligonucleotide comprises a modified nucleotide sequence according to SEQ ID NO: 210; (s) the second modified oligonucleotide comprises a modified nucleotide sequence according to SEQ ID NO: 307 and the first modified oligonucleotide comprises a modified nucleotide sequence according to SEQ ID NO: 211; (t) the second modified oligonucleotide comprises a modified nucleotide sequence according to SEQ ID NO: 308 and the first modified oligonucleotide comprises a modified nucleotide sequence according to SEQ ID NO: 212; (u) the second modified oligonucleotide comprises a modified nucleotide sequence according to SEQ ID NO: 309 and the first modified oligonucleotide comprises a modified nucleotide sequence according to SEQ ID NO: 213; (v) the second modified oligonucleotide comprises a modified nucleotide sequence according to SEQ ID NO: 310 and the first modified oligonucleotide comprises a modified nucleotide sequence according to SEQ ID NO: 214; (w) the second modified oligonucleotide comprises a modified nucleotide sequence according to SEQ ID NO: 311 and the first modified oligonucleotide comprises a modified nucleotide sequence according to SEQ ID NO: 215; (x) the second modified oligonucleotide comprises a modified nucleotide sequence according to SEQ ID NO: 312 and the first modified oligonucleotide comprises a modified nucleotide sequence according to SEQ ID NO: 216; (y) the second modified oligonucleotide comprises a modified nucleotide sequence according to SEQ ID NO: 313 and the first modified oligonucleotide comprises a modified nucleotide sequence according to SEQ ID NO: 217; (z) the second modified oligonucleotide comprises a modified nucleotide sequence according to SEQ ID NO: 314 and the first modified oligonucleotide comprises a modified nucleotide sequence according to SEQ ID NO: 218; (aa) the second modified oligonucleotide comprises a modified nucleotide sequence according to SEQ ID NO: 315 and the first modified oligonucleotide comprises a modified nucleotide sequence according to SEQ ID NO: 219; (bb) the second modified oligonucleotide comprises a modified nucleotide sequence according to SEQ ID NO: 316 and the first modified oligonucleotide comprises a modified nucleotide sequence according to SEQ ID NO: 220; (cc) the second modified oligonucleotide comprises a modified nucleotide sequence according to SEQ ID NO: 317 and the first modified oligonucleotide comprises a modified nucleotide sequence according to SEQ ID NO: 221; (dd) the second modified oligonucleotide comprises a modified nucleotide sequence according to SEQ ID NO: 318 and the first modified oligonucleotide comprises a modified nucleotide sequence according to SEQ ID NO: 222; (ee) the second modified oligonucleotide comprises a modified nucleotide sequence according to SEQ ID NO: 319 and the first modified oligonucleotide comprises a modified nucleotide sequence according to SEQ ID NO: 223; (ff) the second modified oligonucleotide comprises a modified nucleotide sequence according to SEQ ID NO: 320 and the first modified oligonucleotide comprises a modified nucleotide sequence according to SEQ ID NO: 224; (gg) the second modified oligonucleotide comprises a modified nucleotide sequence according to SEQ ID NO: 321 and the first modified oligonucleotide comprises a modified nucleotide sequence according to SEQ ID NO: 225; (hh) the second modified oligonucleotide comprises a modified nucleotide sequence according to SEQ ID NO: 322 and the first modified oligonucleotide comprises a modified nucleotide sequence according to SEQ ID NO: 226; (ii) the second modified oligonucleotide comprises a modified nucleotide sequence according to SEQ ID NO: 323 and the first modified oligonucleotide comprises a modified nucleotide sequence according to SEQ ID NO: 227; (jj) the second modified oligonucleotide comprises a modified nucleotide sequence according to SEQ ID NO: 324 and the first modified oligonucleotide comprises a modified nucleotide sequence according to SEQ ID NO: 228; (kk) the second modified oligonucleotide comprises a modified nucleotide sequence according to SEQ ID NO: 325 and the first modified oligonucleotide comprises a modified nucleotide sequence according to SEQ ID NO: 229; (ll) the second modified oligonucleotide comprises a modified nucleotide sequence according to SEQ ID NO: 326 and the first modified oligonucleotide comprises a modified nucleotide sequence according to SEQ ID NO: 230; (mm) the second modified oligonucleotide comprises a modified nucleotide sequence according to SEQ ID NO: 327 and the first modified oligonucleotide comprises a modified nucleotide sequence according to SEQ ID NO: 231; (nn) the second modified oligonucleotide comprises a modified nucleotide sequence according to SEQ ID NO: 328 and the first modified oligonucleotide comprises a modified nucleotide sequence according to SEQ ID NO: 232; (oo) the second modified oligonucleotide comprises a modified nucleotide sequence according to SEQ ID NO: 329 and the first modified oligonucleotide comprises a modified nucleotide sequence according to SEQ ID NO: 233; (pp) the second modified oligonucleotide comprises a modified nucleotide sequence according to SEQ ID NO: 330 and the first modified oligonucleotide comprises a modified nucleotide sequence according to SEQ ID NO: 234; (qq) the second modified oligonucleotide comprises a modified nucleotide sequence according to SEQ ID NO: 331 and the first modified oligonucleotide comprises a modified nucleotide sequence according to SEQ ID NO: 235; (rr) the second modified oligonucleotide comprises a modified nucleotide sequence according to SEQ ID NO: 332 and the first modified oligonucleotide comprises a modified nucleotide sequence according to SEQ ID NO: 236; (ss) the second modified oligonucleotide comprises a modified nucleotide sequence according to SEQ ID NO: 333 and the first modified oligonucleotide comprises a modified nucleotide sequence according to SEQ ID NO: 237; (tt) the second modified oligonucleotide comprises a modified nucleotide sequence according to SEQ ID NO: 334 and the first modified oligonucleotide comprises a modified nucleotide sequence according to SEQ ID NO: 238; (uu) the second modified oligonucleotide comprises a modified nucleotide sequence according to SEQ ID NO: 335 and the first modified oligonucleotide comprises a modified nucleotide sequence according to SEQ ID NO: 239; (vv) the second modified oligonucleotide comprises a modified nucleotide sequence according to SEQ ID NO: 336 and the first modified oligonucleotide comprises a modified nucleotide sequence according to SEQ ID NO: 240; (ww) the second modified oligonucleotide comprises a modified nucleotide sequence according to SEQ ID NO: 337 and the first modified oligonucleotide comprises a modified nucleotide sequence according to SEQ ID NO: 241; (xx) the second modified oligonucleotide comprises a modified nucleotide sequence according to SEQ ID NO: 338 and the first modified oligonucleotide comprises a modified nucleotide sequence according to SEQ ID NO: 242; (yy) the second modified oligonucleotide comprises a modified nucleotide sequence according to SEQ ID NO: 339 and the first modified oligonucleotide comprises a modified nucleotide sequence according to SEQ ID NO: 243; (zz) the second modified oligonucleotide comprises a modified nucleotide sequence according to SEQ ID NO: 340 and the first modified oligonucleotide comprises a modified nucleotide sequence according to SEQ ID NO: 244; (aaa) the second modified oligonucleotide comprises a modified nucleotide sequence according to SEQ ID NO: 341 and the first modified oligonucleotide comprises a modified nucleotide sequence according to SEQ ID NO: 245; (bbb) the second modified oligonucleotide comprises a modified nucleotide sequence according to SEQ ID NO: 342 and the first modified oligonucleotide comprises a modified nucleotide sequence according to SEQ ID NO: 246; (ccc) the second modified oligonucleotide comprises a modified nucleotide sequence according to SEQ ID NO: 343 and the first modified oligonucleotide comprises a modified nucleotide sequence according to SEQ ID NO: 247; (ddd) the second modified oligonucleotide comprises a modified nucleotide sequence according to SEQ ID NO: 344 and the first modified oligonucleotide comprises a modified nucleotide sequence according to SEQ ID NO: 248; (eee) the second modified oligonucleotide comprises a modified nucleotide sequence according to SEQ ID NO: 345 and the first modified oligonucleotide comprises a modified nucleotide sequence according to SEQ ID NO: 249; (fff) the second modified oligonucleotide comprises a modified nucleotide sequence according to SEQ ID NO: 346 and the first modified oligonucleotide comprises a modified nucleotide sequence according to SEQ ID NO: 250; (ggg) the second modified oligonucleotide comprises a modified nucleotide sequence according to SEQ ID NO: 347 and the first modified oligonucleotide comprises a modified nucleotide sequence according to SEQ ID NO: 251; (hhh) the second modified oligonucleotide comprises a modified nucleotide sequence according to SEQ ID NO: 348 and the first modified oligonucleotide comprises a modified nucleotide sequence according to SEQ ID NO: 252; (iii) the second modified oligonucleotide comprises a modified nucleotide sequence according to SEQ ID NO: 349 and the first modified oligonucleotide comprises a modified nucleotide sequence according to SEQ ID NO: 253; (jjj) the second modified oligonucleotide comprises a modified nucleotide sequence according to SEQ ID NO: 350 and the first modified oligonucleotide comprises a modified nucleotide sequence according to SEQ ID NO: 254; (kkk) the second modified oligonucleotide comprises a modified nucleotide sequence according to SEQ ID NO: 351 and the first modified oligonucleotide comprises a modified nucleotide sequence according to SEQ ID NO: 255; (lll) the second modified oligonucleotide comprises a modified nucleotide sequence according to SEQ ID NO: 352 and the first modified oligonucleotide comprises a modified nucleotide sequence according to SEQ ID NO: 256; (mmm) the second modified oligonucleotide comprises a modified nucleotide sequence according to SEQ ID NO: 353 and the first modified oligonucleotide comprises a modified nucleotide sequence according to SEQ ID NO: 257; (nnn) the second modified oligonucleotide comprises a modified nucleotide sequence according to SEQ ID NO: 354 and the first modified oligonucleotide comprises a modified nucleotide sequence according to SEQ ID NO: 258; (ooo) the second modified oligonucleotide comprises a modified nucleotide sequence according to SEQ ID NO: 355 and the first modified oligonucleotide comprises a modified nucleotide sequence according to SEQ ID NO: 259; (ppp) the second modified oligonucleotide comprises a modified nucleotide sequence according to SEQ ID NO: 356 and the first modified oligonucleotide comprises a modified nucleotide sequence according to SEQ ID NO: 260; (qqq) the second modified oligonucleotide comprises a modified nucleotide sequence according to SEQ ID NO: 357 and the first modified oligonucleotide comprises a modified nucleotide sequence according to SEQ ID NO: 261; (rrr) the second modified oligonucleotide comprises a modified nucleotide sequence according to SEQ ID NO: 358 and the first modified oligonucleotide comprises a modified nucleotide sequence according to SEQ ID NO: 262; (sss) the second modified oligonucleotide comprises a modified nucleotide sequence according to SEQ ID NO: 359 and the first modified oligonucleotide comprises a modified nucleotide sequence according to SEQ ID NO: 263; (ttt) the second modified oligonucleotide comprises a modified nucleotide sequence according to SEQ ID NO: 360 and the first modified oligonucleotide comprises a modified nucleotide sequence according to SEQ ID NO: 264; (uuu) the second modified oligonucleotide comprises a modified nucleotide sequence according to SEQ ID NO: 361 and the first modified oligonucleotide comprises a modified nucleotide sequence according to SEQ ID NO: 265; (vvv) the second modified oligonucleotide comprises a modified nucleotide sequence according to SEQ ID NO: 362 and the first modified oligonucleotide comprises a modified nucleotide sequence according to SEQ ID NO: 266; (www) the second modified oligonucleotide comprises a modified nucleotide sequence according to SEQ ID NO: 363 and the first modified oligonucleotide comprises a modified nucleotide sequence according to SEQ ID NO: 267; (xxx) the second modified oligonucleotide comprises a modified nucleotide sequence according to SEQ ID NO: 364 and the first modified oligonucleotide comprises a modified nucleotide sequence according to SEQ ID NO: 268; (yyy) the second modified oligonucleotide comprises a modified nucleotide sequence according to SEQ ID NO: 365 and the first modified oligonucleotide comprises a modified nucleotide sequence according to SEQ ID NO: 269; (zzz) the second modified oligonucleotide comprises a modified nucleotide sequence according to SEQ ID NO: 366 and the first modified oligonucleotide comprises a modified nucleotide sequence according to SEQ ID NO: 270; (aaaa) the second modified oligonucleotide comprises a modified nucleotide sequence according to SEQ ID NO: 367 and the first modified oligonucleotide comprises a modified nucleotide sequence according to SEQ ID NO: 271; (bbbb) the second modified oligonucleotide comprises a modified nucleotide sequence according to SEQ ID NO: 368 and the first modified oligonucleotide comprises a modified nucleotide sequence according to SEQ ID NO: 272; (cccc) the second modified oligonucleotide comprises a modified nucleotide sequence according to SEQ ID NO: 369 and the first modified oligonucleotide comprises a modified nucleotide sequence according to SEQ ID NO: 273; (dddd) the second modified oligonucleotide comprises a modified nucleotide sequence according to SEQ ID NO: 370 and the first modified oligonucleotide comprises a modified nucleotide sequence according to SEQ ID NO: 274; (eeee) the second modified oligonucleotide comprises a modified nucleotide sequence according to SEQ ID NO: 371 and the first modified oligonucleotide comprises a modified nucleotide sequence according to SEQ ID NO: 275; (ffff) the second modified oligonucleotide comprises a modified nucleotide sequence according to SEQ ID NO: 372 and the first modified oligonucleotide comprises a modified nucleotide sequence according to SEQ ID NO: 276; (gggg) the second modified oligonucleotide comprises a modified nucleotide sequence according to SEQ ID NO: 373 and the first modified oligonucleotide comprises a modified nucleotide sequence according to SEQ ID NO: 277; (hhhh) the second modified oligonucleotide comprises a modified nucleotide sequence according to SEQ ID NO: 374 and the first modified oligonucleotide comprises a modified nucleotide sequence according to SEQ ID NO: 278; (iiii) the second modified oligonucleotide comprises a modified nucleotide sequence according to SEQ ID NO: 375 and the first modified oligonucleotide comprises a modified nucleotide sequence according to SEQ ID NO: 279; (jjjj) the second modified oligonucleotide comprises a modified nucleotide sequence according to SEQ ID NO: 376 and the first modified oligonucleotide comprises a modified nucleotide sequence according to SEQ ID NO: 280; (kkkk) the second modified oligonucleotide comprises a modified nucleotide sequence according to SEQ ID NO: 377 and the first modified oligonucleotide comprises a modified nucleotide sequence according to SEQ ID NO: 281; (llll) the second modified oligonucleotide comprises a modified nucleotide sequence according to SEQ ID NO: 378 and the first modified oligonucleotide comprises a modified nucleotide sequence according to SEQ ID NO: 282; (mmmm) the second modified oligonucleotide comprises a modified nucleotide sequence according to SEQ ID NO: 379 and the first modified oligonucleotide comprises a modified nucleotide sequence according to SEQ ID NO: 283; (nnnn) the second modified oligonucleotide comprises a modified nucleotide sequence according to SEQ ID NO: 380 and the first modified oligonucleotide comprises a modified nucleotide sequence according to SEQ ID NO: 284; (oooo) the second modified oligonucleotide comprises a modified nucleotide sequence according to SEQ ID NO: 381 and the first modified oligonucleotide comprises a modified nucleotide sequence according to SEQ ID NO: 285; (pppp) the second modified oligonucleotide comprises a modified nucleotide sequence according to SEQ ID NO: 382 and the first modified oligonucleotide comprises a modified nucleotide sequence according to SEQ ID NO: 286; (qqqq) the second modified oligonucleotide comprises a modified nucleotide sequence according to SEQ ID NO: 383 and the first modified oligonucleotide comprises a modified nucleotide sequence according to SEQ ID NO: 287; (rrrr) the second modified oligonucleotide comprises a modified nucleotide sequence according to SEQ ID NO: 384 and the first modified oligonucleotide comprises a modified nucleotide sequence according to SEQ ID NO: 288; (ssss) the second modified oligonucleotide comprises a modified nucleobase sequence according to SEQ ID NO: 604 and the first modified oligonucleotide comprises a modified nucleobase sequence according to SEQ ID NO: 531; (tttt) the second modified oligonucleotide comprises a modified nucleobase sequence according to SEQ ID NO: 605 and the first modified oligonucleotide comprises a modified nucleobase sequence according to SEQ ID NO: 532; (uuuu) the second modified oligonucleotide comprises a modified nucleobase sequence according to SEQ ID NO: 606 and the first modified oligonucleotide comprises a modified nucleobase sequence according to SEQ ID NO: 533; (vvvv) the second modified oligonucleotide comprises a modified nucleobase sequence according to SEQ ID NO: 607 and the first modified oligonucleotide comprises a modified nucleobase sequence according to SEQ ID NO: 534; (wwww) the second modified oligonucleotide comprises a modified nucleobase sequence according to SEQ ID NO: 608 and the first modified oligonucleotide comprises a modified nucleobase sequence according to SEQ ID NO: 535; (xxxx) the second modified oligonucleotide comprises a modified nucleobase sequence according to SEQ ID NO: 609 and the first modified oligonucleotide comprises a modified nucleobase sequence according to SEQ ID NO: 536; (yyyy) the second modified oligonucleotide comprises a modified nucleobase sequence according to SEQ ID NO: 610 and the first modified oligonucleotide comprises a modified nucleobase sequence according to SEQ ID NO: 537; (zzzz) the second modified oligonucleotide comprises a modified nucleobase sequence according to SEQ ID NO: 611 and the first modified oligonucleotide comprises a modified nucleobase sequence according to SEQ ID NO: 538; (aaaaa) the second modified oligonucleotide comprises a modified nucleobase sequence according to SEQ ID NO: 612 and the first modified oligonucleotide comprises a modified nucleobase sequence according to SEQ ID NO: 539; (bbbbb) the second modified oligonucleotide comprises a modified nucleobase sequence according to SEQ ID NO: 613 and the first modified oligonucleotide comprises a modified nucleobase sequence according to SEQ ID NO: 540; (ccccc) the second modified oligonucleotide comprises a modified nucleobase sequence according to SEQ ID NO: 614 and the first modified oligonucleotide comprises a modified nucleobase sequence according to SEQ ID NO: 541; (ddddd) the second modified oligonucleotide comprises a modified nucleobase sequence according to SEQ ID NO: 615 and the first modified oligonucleotide comprises a modified nucleobase sequence according to SEQ ID NO: 542; (eeeee) the second modified oligonucleotide comprises a modified nucleobase sequence according to SEQ ID NO: 616 and the first modified oligonucleotide comprises a modified nucleobase sequence according to SEQ ID NO: 543; (fffff) the second modified oligonucleotide comprises a modified nucleobase sequence according to SEQ ID NO: 617 and the first modified oligonucleotide comprises a modified nucleobase sequence according to SEQ ID NO: 544; (ggggg) the second modified oligonucleotide comprises a modified nucleobase sequence according to SEQ ID NO: 618 and the first modified oligonucleotide comprises a modified nucleobase sequence according to SEQ ID NO: 545; (hhhhh) the second modified oligonucleotide comprises a modified nucleobase sequence according to SEQ ID NO: 619 and the first modified oligonucleotide comprises a modified nucleobase sequence according to SEQ ID NO: 546; (iiiii) the second modified oligonucleotide comprises a modified nucleobase sequence according to SEQ ID NO: 620 and the first modified oligonucleotide comprises a modified nucleobase sequence according to SEQ ID NO: 547; (jjjjj) the second modified oligonucleotide comprises a modified nucleobase sequence according to SEQ ID NO: 621 and the first modified oligonucleotide comprises a modified nucleobase sequence according to SEQ ID NO: 548; (kkkkk) the second modified oligonucleotide comprises a modified nucleobase sequence according to SEQ ID NO: 622 and the first modified oligonucleotide comprises a modified nucleobase sequence according to SEQ ID NO: 549; (lllll) the second modified oligonucleotide comprises a modified nucleobase sequence according to SEQ ID NO: 623 and the first modified oligonucleotide comprises a modified nucleobase sequence according to SEQ ID NO: 550; (mmmmm) the second modified oligonucleotide comprises a modified nucleobase sequence according to SEQ ID NO: 624 and the first modified oligonucleotide comprises a modified nucleobase sequence according to SEQ ID NO: 551; (nnnnn) the second modified oligonucleotide comprises a modified nucleobase sequence according to SEQ ID NO: 625 and the first modified oligonucleotide comprises a modified nucleobase sequence according to SEQ ID NO: 552; (ooooo) the second modified oligonucleotide comprises a modified nucleobase sequence according to SEQ ID NO: 626 and the first modified oligonucleotide comprises a modified nucleobase sequence according to SEQ ID NO: 553; (ppppp) the second modified oligonucleotide comprises a modified nucleobase sequence according to SEQ ID NO: 627 and the first modified oligonucleotide comprises a modified nucleobase sequence according to SEQ ID NO: 554; (qqqqq) the second modified oligonucleotide comprises a modified nucleobase sequence according to SEQ ID NO: 628 and the first modified oligonucleotide comprises a modified nucleobase sequence according to SEQ ID NO: 555; (rrrrr) the second modified oligonucleotide comprises a modified nucleobase sequence according to SEQ ID NO: 629 and the first modified oligonucleotide comprises a modified nucleobase sequence according to SEQ ID NO: 556; (sssss) the second modified oligonucleotide comprises a modified nucleobase sequence according to SEQ ID NO: 630 and the first modified oligonucleotide comprises a modified nucleobase sequence according to SEQ ID NO: 557; (ttttt) the second modified oligonucleotide comprises a modified nucleobase sequence according to SEQ ID NO: 631 and the first modified oligonucleotide comprises a modified nucleobase sequence according to SEQ ID NO: 558; (uuuuu) the second modified oligonucleotide comprises a modified nucleobase sequence according to SEQ ID NO: 632 and the first modified oligonucleotide comprises a modified nucleobase sequence according to SEQ ID NO: 559; (vvvvv) the second modified oligonucleotide comprises a modified nucleobase sequence according to SEQ ID NO: 633 and the first modified oligonucleotide comprises a modified nucleobase sequence according to SEQ ID NO: 560; (wwwww) the second modified oligonucleotide comprises a modified nucleobase sequence according to SEQ ID NO: 634 and the first modified oligonucleotide comprises a modified nucleobase sequence according to SEQ ID NO: 561; (xxxxx) the second modified oligonucleotide comprises a modified nucleobase sequence according to SEQ ID NO: 635 and the first modified oligonucleotide comprises a modified nucleobase sequence according to SEQ ID NO: 562; (yyyyy) the second modified oligonucleotide comprises a modified nucleobase sequence according to SEQ ID NO: 636 and the first modified oligonucleotide comprises a modified nucleobase sequence according to SEQ ID NO: 563; (zzzzz) the second modified oligonucleotide comprises a modified nucleobase sequence according to SEQ ID NO: 637 and the first modified oligonucleotide comprises a modified nucleobase sequence according to SEQ ID NO: 564; (aaaaaa) the second modified oligonucleotide comprises a modified nucleobase sequence according to SEQ ID NO: 638 and the first modified oligonucleotide comprises a modified nucleobase sequence according to SEQ ID NO: 565; (bbbbbb) the second modified oligonucleotide comprises a modified nucleobase sequence according to SEQ ID NO: 639 and the first modified oligonucleotide comprises a modified nucleobase sequence according to SEQ ID NO: 566; (cccccc) the second modified oligonucleotide comprises a modified nucleobase sequence according to SEQ ID NO: 640 and the first modified oligonucleotide comprises a modified nucleobase sequence according to SEQ ID NO: 567; (dddddd) the second modified oligonucleotide comprises a modified nucleobase sequence according to SEQ ID NO: 641 and the first modified oligonucleotide comprises a modified nucleobase sequence according to SEQ ID NO: 568; (eeeeee) the second modified oligonucleotide comprises a modified nucleobase sequence according to SEQ ID NO: 642 and the first modified oligonucleotide comprises a modified nucleobase sequence according to SEQ ID NO: 569; (ffffff) the second modified oligonucleotide comprises a modified nucleobase sequence according to SEQ ID NO: 643 and the first modified oligonucleotide comprises a modified nucleobase sequence according to SEQ ID NO: 570; (gggggg) the second modified oligonucleotide comprises a modified nucleobase sequence according to SEQ ID NO: 644 and the first modified oligonucleotide comprises a modified nucleobase sequence according to SEQ ID NO: 571; (hhhhhh) the second modified oligonucleotide comprises a modified nucleobase sequence according to SEQ ID NO: 645 and the first modified oligonucleotide comprises a modified nucleobase sequence according to SEQ ID NO: 572; (iiiiii) the second modified oligonucleotide comprises a modified nucleobase sequence according to SEQ ID NO: 646 and the first modified oligonucleotide comprises a modified nucleobase sequence according to SEQ ID NO: 573; (jjjjjj) the second modified oligonucleotide comprises a modified nucleobase sequence according to SEQ ID NO: 647 and the first modified oligonucleotide comprises a modified nucleobase sequence according to SEQ ID NO: 574; (kkkkkk) the second modified oligonucleotide comprises a modified nucleobase sequence according to SEQ ID NO: 648 and the first modified oligonucleotide comprises a modified nucleobase sequence according to SEQ ID NO: 575; (llllll) the second modified oligonucleotide comprises a modified nucleobase sequence according to SEQ ID NO: 649 and the first modified oligonucleotide comprises a modified nucleobase sequence according to SEQ ID NO: 576; (mmmmmm) the second modified oligonucleotide comprises a modified nucleobase sequence according to SEQ ID NO: 650 and the first modified oligonucleotide comprises a modified nucleobase sequence according to SEQ ID NO: 577; (nnnnnn) the second modified oligonucleotide comprises a modified nucleobase sequence according to SEQ ID NO: 651 and the first modified oligonucleotide comprises a modified nucleobase sequence according to SEQ ID NO: 578; (oooooo) the second modified oligonucleotide comprises a modified nucleobase sequence according to SEQ ID NO: 652 and the first modified oligonucleotide comprises a modified nucleobase sequence according to SEQ ID NO: 579; (pppppp) the second modified oligonucleotide comprises a modified nucleobase sequence according to SEQ ID NO: 653 and the first modified oligonucleotide comprises a modified nucleobase sequence according to SEQ ID NO: 580; (qqqqqq) the second modified oligonucleotide comprises a modified nucleobase sequence according to SEQ ID NO: 654 and the first modified oligonucleotide comprises a modified nucleobase sequence according to SEQ ID NO: 581; (rrrrrr) the second modified oligonucleotide comprises a modified nucleobase sequence according to SEQ ID NO: 655 and the first modified oligonucleotide comprises a modified nucleobase sequence according to SEQ ID NO: 582; (ssssss) the second modified oligonucleotide comprises a modified nucleobase sequence according to SEQ ID NO: 656 and the first modified oligonucleotide comprises a modified nucleobase sequence according to SEQ ID NO: 583; (tttttt) the second modified oligonucleotide comprises a modified nucleobase sequence according to SEQ ID NO: 657 and the first modified oligonucleotide comprises a modified nucleobase sequence according to SEQ ID NO: 584; (uuuuuu) the second modified oligonucleotide comprises a modified nucleobase sequence according to SEQ ID NO: 658 and the first modified oligonucleotide comprises a modified nucleobase sequence according to SEQ ID NO: 585; (vvvvvv) the second modified oligonucleotide comprises a modified nucleobase sequence according to SEQ ID NO: 659 and the first modified oligonucleotide comprises a modified nucleobase sequence according to SEQ ID NO: 586; (wwwwww) the second modified oligonucleotide comprises a modified nucleobase sequence according to SEQ ID NO: 660 and the first modified oligonucleotide comprises a modified nucleobase sequence according to SEQ ID NO: 587; (xxxxxx) the second modified oligonucleotide comprises a modified nucleobase sequence according to SEQ ID NO: 661 and the first modified oligonucleotide comprises a modified nucleobase sequence according to SEQ ID NO: 588; (yyyyyy) the second modified oligonucleotide comprises a modified nucleobase sequence according to SEQ ID NO: 662 and the first modified oligonucleotide comprises a modified nucleobase sequence according to SEQ ID NO:

589; (zzzzzz) the second modified oligonucleotide comprises a modified nucleobase sequence according to SEQ ID NO: 663 and the first modified oligonucleotide comprises a modified nucleobase sequence according to SEQ ID NO: 590; (aaaaaaa) the second modified oligonucleotide comprises a modified nucleobase sequence according to SEQ ID NO: 664 and the first modified oligonucleotide comprises a modified nucleobase sequence according to SEQ ID NO: 591; (bbbbbbb) the second modified oligonucleotide comprises a modified nucleobase sequence according to SEQ ID NO: 665 and the first modified oligonucleotide comprises a modified nucleobase sequence according to SEQ ID NO: 592; (ccccccc) the second modified oligonucleotide comprises a modified nucleobase sequence according to SEQ ID NO: 666 and the first modified oligonucleotide comprises a modified nucleobase sequence according to SEQ ID NO: 593; (ddddddd) the second modified oligonucleotide comprises a modified nucleobase sequence according to SEQ ID NO: 667 and the first modified oligonucleotide comprises a modified nucleobase sequence according to SEQ ID NO: 594; (eeeeeee) the second modified oligonucleotide comprises a modified nucleobase sequence according to SEQ ID NO: 668 and the first modified oligonucleotide comprises a modified nucleobase sequence according to SEQ ID NO: 595; (fffffff) the second modified oligonucleotide comprises a modified nucleobase sequence according to SEQ ID NO: 669 and the first modified oligonucleotide comprises a modified nucleobase sequence according to SEQ ID NO: 596; (ggggggg) the second modified oligonucleotide comprises a modified nucleobase sequence according to SEQ ID NO: 670 and the first modified oligonucleotide comprises a modified nucleobase sequence according to SEQ ID NO: 597; (hhhhhhh) the second modified oligonucleotide comprises a modified nucleobase sequence according to SEQ ID NO: 671 and the first modified oligonucleotide comprises a modified nucleobase sequence according to SEQ ID NO: 598; (iiiiiii) the second modified oligonucleotide comprises a modified nucleobase sequence according to SEQ ID NO: 672 and the first modified oligonucleotide comprises a modified nucleobase sequence according to SEQ ID NO: 599; (jjjjjjj) the second modified oligonucleotide comprises a modified nucleobase sequence according to SEQ ID NO: 673 and the first modified oligonucleotide comprises a modified nucleobase sequence according to SEQ ID NO: 600; (kkkkkkk) the second modified oligonucleotide comprises a modified nucleobase sequence according to SEQ ID NO: 674 and the first modified oligonucleotide comprises a modified nucleobase sequence according to SEQ ID NO: 601; (lllllll) the second modified oligonucleotide comprises a modified nucleobase sequence according to SEQ ID NO: 675 and the first modified oligonucleotide comprises a modified nucleobase sequence according to SEQ ID NO: 602; (mmmmmmm) the second modified oligonucleotide comprises a modified nucleobase sequence according to SEQ ID NO: 676 and the first modified oligonucleotide comprises a modified nucleobase sequence according to SEQ ID NO: 603; (nnnnnnn) the second modified oligonucleotide comprises a modified nucleobase sequence according to SEQ ID NO: 713 and the first modified oligonucleotide comprises a modified nucleobase sequence according to SEQ ID NO: 701; (ooooooo) the second modified oligonucleotide comprises a modified nucleobase sequence according to SEQ ID NO: 714 and the first modified oligonucleotide comprises a modified nucleobase sequence according to SEQ ID NO: 702; (ppppppp) the second modified oligonucleotide comprises a modified nucleobase sequence according to SEQ ID NO: 715 and the first modified oligonucleotide comprises a modified nucleobase sequence according to SEQ ID NO: 703; (qqqqqqq) the second modified oligonucleotide comprises a modified nucleobase sequence according to SEQ ID NO: 716 and the first modified oligonucleotide comprises a modified nucleobase sequence according to SEQ ID NO: 704; (rrrrrr) the second modified oligonucleotide comprises a modified nucleobase sequence according to SEQ ID NO: 717 and the first modified oligonucleotide comprises a modified nucleobase sequence according to SEQ ID NO: 705; (sssssss) the second modified oligonucleotide comprises a modified nucleobase sequence according to SEQ ID NO: 718 and the first modified oligonucleotide comprises a modified nucleobase sequence according to SEQ ID NO: 706; (tttttt) the second modified oligonucleotide comprises a modified nucleobase sequence according to SEQ ID NO: 719 and the first modified oligonucleotide comprises a modified nucleobase sequence according to SEQ ID NO: 707; (uuuuuuu) the second modified oligonucleotide comprises a modified nucleobase sequence according to SEQ ID NO: 720 and the first modified oligonucleotide comprises a modified nucleobase sequence according to SEQ ID NO: 708; (vvvvvvv) the second modified oligonucleotide comprises a modified nucleobase sequence according to SEQ ID NO: 721 and the first modified oligonucleotide comprises a modified nucleobase sequence according to SEQ ID NO: 709; (wwwwwww) the second modified oligonucleotide comprises a modified nucleobase sequence according to SEQ ID NO: 722 and the first modified oligonucleotide comprises a modified nucleobase sequence according to SEQ ID NO: 710; (xxxxxxx) the second modified oligonucleotide comprises a modified nucleobase sequence according to SEQ ID NO: 723 and the first modified oligonucleotide comprises a modified nucleobase sequence according to SEQ ID NO: 711; (yyyyyyy) the second modified oligonucleotide comprises a modified nucleobase sequence according to SEQ ID NO: 724 and the antisecond modified oligonucleotide comprises a modified nucleobase sequence according to SEQ ID NO: 712; (aaaaaaaa) the second modified oligonucleotide comprises a modified nucleobase sequence according to SEQ ID NO: 726 and the first modified oligonucleotide comprises a modified nucleobase sequence according to SEQ ID NO: 603; (bbbbbbbb) the second modified oligonucleotide comprises a modified nucleobase sequence according to SEQ ID NO: 727 and the first modified oligonucleotide comprises a modified nucleobase sequence according to SEQ ID NO: 596; (cccccccc) the second modified oligonucleotide comprises a modified nucleobase sequence according to SEQ ID NO: 728 and the first modified oligonucleotide comprises a modified nucleobase sequence according to SEQ ID NO: 703; (dddddddd) the second modified oligonucleotide comprises a modified nucleobase sequence according to SEQ ID NO: 729 and the first modified oligonucleotide comprises a modified nucleobase sequence according to SEQ ID NO: 701; (eeeeeeee) the second modified oligonucleotide comprises a modified nucleobase sequence according to SEQ ID NO: 730 and the first modified oligonucleotide comprises a modified nucleobase sequence according to SEQ ID NO: 595; or (ffffffff) the second modified oligonucleotide comprises a modified nucleobase sequence according to SEQ ID NO: 731 and the first modified oligonucleotide comprises a modified nucleobase sequence according to SEQ ID NO: 704.

In some implementations, the first modified oligonucleotide and/or second modified oligonucleotide comprises a targeting ligand. In some implementations, the first modified oligonucleotide comprises a targeting ligand conjugated to its 3' end. In some implementations, the first modified oligonucleotide comprises a targeting ligand conjugated to its 5' end. In some implementations, the second modified oligonucleotide comprises a targeting ligand conjugated to its 3' end. In some implementations, the second modified oligonucleotide comprises a targeting ligand conjugated to its 5' end. In some implementations, the targeting ligand targets a hepatocyte, and optionally wherein the targeting ligand comprises a galactose trimer. In some implementations, the targeting ligand comprises N-acetylgalactosamine (GalNac).

In some implementations, the targeting ligand comprises a structure according to Formula I:

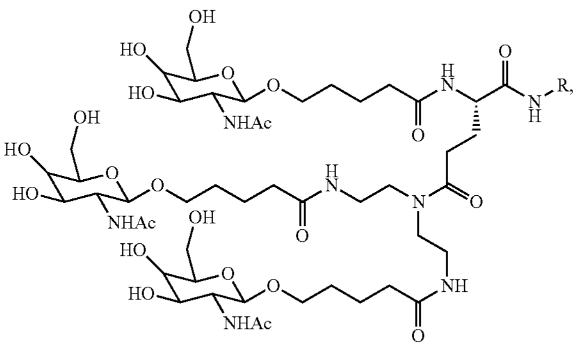

wherein R is:

(i) the first modified oligonucleotide or the second modified oligonucleotide; or (ii) a linker conjugated to the first modified oligonucleotide or the second modified oligonucleotide. In some implementations, R is a linker conjugated to the first modified oligonucleotide or the second modified oligonucleotide having a structure according to Formula III:

Formula III

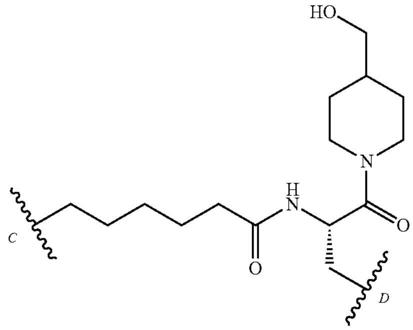

wherein:

(i) connection point C of Formula III is conjugated to Formula I, and connection point D of Formula III is conjugated to the first modified oligonucleotide or the second modified oligonucleotide; or (ii) connection point C of Formula III is conjugated to Formula I, and connection point D of Formula III is conjugated to a phosphate group which is conjugated to the first modified oligonucleotide or the second modified oligonucleotide. In some implementations, Formula III or the phosphate group is conjugated to the 3' end or 5' end of the first modified oligonucleotide or the second modified oligonucleotide. In some implementations, Formula III or the phosphate group is conjugated to an internal nucleotide or nucleoside base of the first modified oligonucleotide or the second modified oligonucleotide.

In some implementations, the first modified oligonucleotide or the second modified oligonucleotide comprises a targeting ligand and linker according to Formula V:

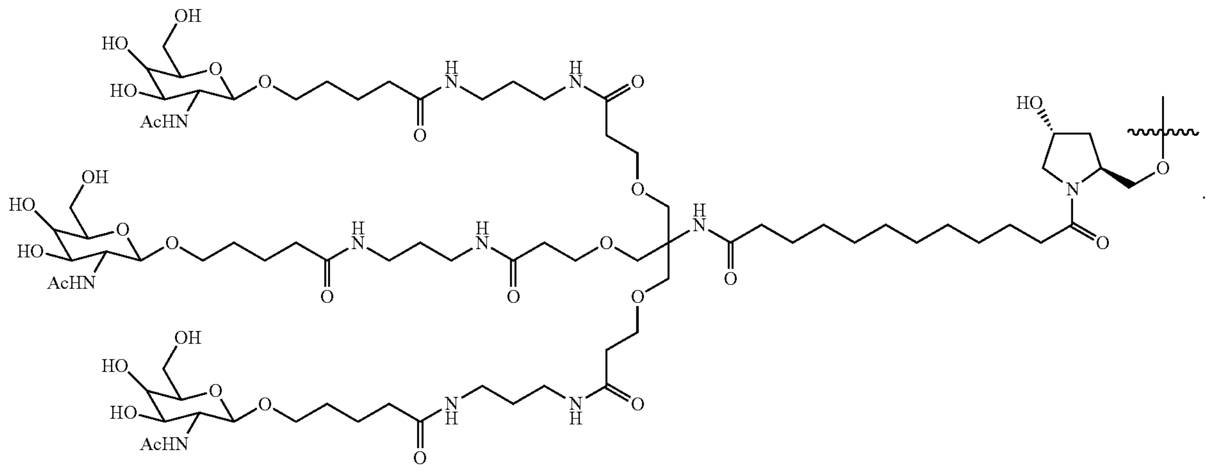 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

In some implementations, the oligomeric duplex is an siRNA molecule. In some implementations, the oligomeric duplex is an shRNA molecule.

Also described herein is a pharmaceutical composition comprising the RNAi agent described herein, the modified oligonucleotide described herein, or the oligomeric duplex described herein, and a pharmaceutically acceptable carrier.

Further described herein is a lipid nanoparticle comprising the RNAi agent described herein, the modified oligonucleotide described herein, the oligomeric duplex described herein, or the pharmaceutical composition described herein.

Also described herein is a method of making a pharmaceutical composition, comprising combining the RNAi agent described herein, the modified described herein, or the oligomeric duplex described herein, with a delivery vehicle selected from the group consisting of a phosphate-buffered saline (PBS), lipid, a nanoparticle, a polymer, a liposome, a micelle, a dynamic polyconjugate (DPC), and antibody-oligo conjugate.

Further described is a method of treating nonalcoholic fatty liver disease (NAFLD) or nonalcoholic steatohepatitis (NASH) in a subject, comprising administering to the subject an effective amount of a liver-targeted modified oligonucleotide, a liver-targeted oligomeric duplex, or a liver-targeted RNAi agent that inhibits expression of insulin receptor substrate-1 (IRS1).

Also described herein is a use of a liver-targeted modified oligonucleotide, a liver-targeted oligomeric duplex, or a liver-targeted RNAi agent that inhibits expression of insulin receptor substrate-1 (IRS1) for the manufacture of a medicament for the treatment of nonalcoholic fatty liver disease (NAFLD) or nonalcoholic steatohepatitis (NASH) in a subject.

Further described herein is a method of inhibiting expression of insulin receptor substrate-1 (IRS1) in a subject, comprising administering to the subject an effective amount of a liver-targeted modified oligonucleotide, a liver-targeted oligomeric duplex, or a liver-targeted RNAi agent that inhibits expression of IRS1.

Also described herein is a use of a liver-targeted modified oligonucleotide, a liver-targeted oligomeric duplex, or a liver-targeted RNAi agent in the manufacture of a medicament for inhibiting expression of insulin receptor substrate 1 (IRS1) in a hepatocyte of a subject.

Further described herein is a method of controlling or reducing liver fat accumulation in a subject, comprising administering to the subject an effective amount of a liver-targeted modified oligonucleotide, a liver-targeted oligomeric duplex, or a liver-targeted RNAi agent that inhibits expression of IRS1.

Also described herein is a use of a liver-targeted modified oligonucleotide, a liver-targeted oligomeric duplex, or a liver-targeted RNAi agent that inhibits expression of insulin receptor substrate-1 (IRS1) in the manufacture of a medicament for controlling or reducing liver fat accumulation in a subject.

In some implementations of the method or use, the method treats metabolic dysfunction-associated steatotic liver disease (MASLD) or metabolic dysfunction-associated steatohepatitis (MASH) in the subject.

In some implementations of the method or use, the method treats nonalcoholic fatty liver disease (NAFLD) or nonalcoholic steatohepatitis (NASH) in the subject.

In some implementations of the method or use, the liver-targeted modified oligonucleotide is the modified oligonucleotide as described herein.

In some implementations of the method or use, the liver-targeted oligomeric duplex is the oligomeric duplex as described herein.

In some implementations of the method or use, the RNAi agent comprises an antisense strand and a sense strand that at least partially complements the antisense strand, wherein (a) the antisense strand comprises at least 14 contiguous bases from any one of SEQ ID NOS: 1-96, 385-457, and 677-688; and/or (b) the sense strand comprises at least 14 contiguous bases from any one of SEQ ID NOS: 97-192, 458-530, and 689-700.

In some implementations of the method or use, one or more bases of the antisense stand and/or the sense strand are modified. In some implementations, (a) the antisense strand comprises at least 14 contiguous bases from any one of SEQ ID NOS: 193-288, 531-603, and 701-712; and/or (b) the sense strand comprises at least 14 contiguous bases from any one of SEQ ID NOS: 289-384, 604-676, 713-724, and 726-731.

In some implementations of the method or use, the RNAi agent comprises an antisense strand and a sense strand that at least partially complements the antisense strand, and a targeting ligand conjugated to the antisense strand or the sense strand, wherein the targeting ligand targets a hepatocyte.

In some implementations of the method or use, the antisense strand comprises at least 14 contiguous bases that complement a sequence in an mRNA molecule that encodes IRS1 (SEQ ID NO: 725).

In some implementations of the method or use, the antisense strand and the sense strand form a duplex of at least 14 bases in length. In some implementations, the antisense strand and the sense strand form a duplex of between 15 and 30 bases in length. In some implementations, the antisense strand or a subsequence thereof differs by 0, 1, 2, 3, or 4 nucleotides from an equal length portion of any one of SEQ ID NOS: 1-96, 385-457, 677-688, 193-288, 531-603, and 701-712, wherein the subsequence is at least 14, 15, 16, 17, 18, 19, 20, or 21 bases in length. In some implementations, the antisense strand comprises, in order, nucleotides 2-23 of any one of SEQ ID NOS: 1-96, 385-457, 677-688, 193-288, 531-603, and 701-712. In some implementations, the antisense strand comprises at least 14 contiguous bases from any one of SEQ ID NOS: 1-96, 385-457, 677-688, 193-288, 531-603, and 701-712. In some implementations, the antisense strand comprises, in order, nucleobases 1-14 of any one of SEQ ID NOS: 1-96, 385-457, 677-688, 193-288, 531-603, and 701-712. In some implementations, the antisense strand comprises at least 14 contiguous bases from any one of SEQ ID NOS: 449, 450, 457, 595, 596, 603, 677, 679, 680, 701, 703, and 704.

In some implementations of the method or use, the sense strand or a subsequence thereof differs by 0, 1, 2, 3, or 4 nucleotides from an equal length portion of any one of SEQ ID NOS: 97-192, 458-530, 689-700, 289-384, 604-676, 713-724, and 726-731, wherein the subsequence is at least 14, 15, 16, 17, 18, 19, 20, or 21 bases in length. In some implementations, the sense strand comprises, in order, nucleotides 1-22 of any one of SEQ ID NOS: 97-192, 458-530, 689-700, 289-384, 604-676, 713-724, and 726-731. In some implementations, the sense strand comprises at least 14 contiguous bases from any one of SEQ ID NOS: 97-192, 458-530, 689-700, 289-384, 604-676, 713-724, and 726-731. In some implementations, the sense strand comprises, in order, nucleobases 1-14 of any one of SEQ ID NOS: 97-192, 458-530, 689-700, 289-384, 604-676, 713-724, and 726-731. In some implementations, the sense strand comprises at least 14 contiguous bases from any one of SEQ ID NOS: 522, 523, 530, 689, 691, 692, 668, 669, 676, 713, 715, 716, and 726-731.

In some implementations of the method or use, the antisense strand comprises at least 16 contiguous bases that complement a sequence in an mRNA molecule that encodes IRS1 (SEQ ID NO: 725). In some implementations, the antisense strand and the sense strand form a duplex of at least 16 bases in length. In some implementations, the antisense strand comprises at least 16 contiguous bases from any one of SEQ ID NOS: 1-96, 385-457, 677-688, 193-288, 531-603, and 701-712. In some implementations, the antisense strand comprises at least 16 contiguous bases from any one of SEQ ID NOS: 449, 450, 457, 595, 596, 603, 677, 679, 680, 701, 703, and 704. In some implementations, the antisense strand comprises, in order, nucleobases 1-16, 1-17, 1-18, 1-19, 1-20, 1-21, 1-22, 1-23, 2-17, 2-18, 2-19, 2-20, 2-21, 2-22, 2-23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 1-96, 385-457, 677-688, 193-288, 531-603, and 701-712. In some implementations, the antisense strand comprises a nucleotide sequence according to any one of SEQ ID NOS: 1-96, 385-457, and 677-688. In some implementations, one or more nucleotides of the antisense strand are modified. In some implementations, the antisense strand comprises a nucleotide sequence according to any one of SEQ ID NOS: 449, 450, 457, 677, 679, and 680. In some implementations, one or more nucleotides of the antisense strand are modified. In some implementations, the antisense strand has a modification pattern according to nsNfsnnnNfnnnnnnnNfnNfnnnnnsnsn. In some implementations, the antisense strand comprises a modified nucleotide sequence according to any one of SEQ ID NOS: 193-288, 531-603, and 701-712. In some implementations, the antisense strand comprises a modified nucleotide sequence according to any one of SEQ ID NOS: 595, 596, 603, 701, 703, and 704.

In some implementations of the method or use, the sense strand comprises at least 16 contiguous bases from any one of SEQ ID NOS: 97-192, 458-530, 689-700, 289-384, 604-676, 713-724, and 726-731. In some implementations, the sense strand comprises at least 16 contiguous bases from any one of SEQ ID NOS: 522, 523, 530, 689, 691, 692, and 726-731. In some implementations, the sense strand comprises, in order, nucleobases 1-16, 1-17, 1-18, 1-19, 1-20, 1-21, 1-22, 1-23, 2-17, 2-18, 2-19, 2-20, 2-21, 2-22, 2-23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 97-192, 458-530, 689-700, 289-384, 604-676, 713-724, and 726-731. In some implementations, the sense strand comprises a nucleobase sequence according to any one of SEQ ID NOS: 97-192, 458-530, and 689-700. In some implementations, one or more nucleotides of the sense strand are modified. In some implementations, the sense strand comprises a nucleobase sequence according to any one of SEQ ID NOS: 522, 523, 530, 689, 691, and 692. In some implementations, one or more nucleotides of the sense strand are modified. In some implementations, the sense strand has a modification pattern according to nsnsnnnnNfnNfNfNfnnnnnnnnnsnsn. In some implementations, the sense strand has a modification pattern according to nsnsnnnnNfnNfNfNfnnnnnnnnnnn. In some implementations, the sense strand comprises a modified nucleotide sequence according to any one of SEQ ID NOS: 289-384, 604-676, 713-724, and 726-731. In some implementations, the sense strand comprises a modified nucleotide sequence according to any one of SEQ ID NOS: 668, 669, 676, 713, 715, 716, and 726-731.

In some implementations of the method or use, (a) the sense strand comprises a nucleobase sequence according to SEQ ID NO: 97 and the antisense strand comprises a nucleobase sequence according to SEQ ID NO: 1; (b) the sense strand comprises a nucleobase sequence according to SEQ ID NO: 98 and the antisense strand comprises a nucleobase sequence according to SEQ ID NO: 2; (c) the sense strand comprises a nucleobase sequence according to SEQ ID NO: 99 and the antisense strand comprises a nucleobase sequence according to SEQ ID NO: 3; (d) the sense strand comprises a nucleobase sequence according to SEQ ID NO: 100 and the antisense strand comprises a nucleobase sequence according to SEQ ID NO: 4; (e) the sense strand comprises a nucleobase sequence according to SEQ ID NO: 101 and the antisense strand comprises a nucleobase sequence according to SEQ ID NO: 5; (f) the sense strand comprises a nucleobase sequence according to SEQ ID NO: 102 and the antisense strand comprises a nucleobase sequence according to SEQ ID NO: 6; (g) the sense strand comprises a nucleobase sequence according to SEQ ID NO: 103 and the antisense strand comprises a nucleobase sequence according to SEQ ID NO: 7; (h) the sense strand comprises a nucleobase sequence according to SEQ ID NO: 104 and the antisense strand comprises a nucleobase sequence according to SEQ ID NO: 8; (i) the sense strand comprises a nucleobase sequence according to SEQ ID NO: 105 and the antisense strand comprises a nucleobase sequence according to SEQ ID NO: 9; (j) the sense strand comprises a nucleobase sequence according to SEQ ID NO: 106 and the antisense strand comprises a nucleobase sequence according to SEQ ID NO: 10; (k) the sense strand comprises a nucleobase sequence according to SEQ ID NO: 107 and the antisense strand comprises a nucleobase sequence according to SEQ ID NO: 11; (l) the sense strand comprises a nucleobase sequence according to SEQ ID NO: 108 and the antisense strand comprises a nucleobase sequence according to SEQ ID NO: 12; (m) the sense strand comprises a nucleobase sequence according to SEQ ID NO: 109 and the antisense strand comprises a nucleobase sequence according to SEQ ID NO: 13; (n) the sense strand comprises a nucleobase sequence according to SEQ ID NO: 110 and the antisense strand comprises a nucleobase sequence according to SEQ ID NO: 14; (o) the sense strand comprises a nucleobase sequence according to SEQ ID NO: 111 and the antisense strand comprises a nucleobase sequence according to SEQ ID NO: 15; (p) the sense strand comprises a nucleobase sequence according to SEQ ID NO: 112 and the antisense strand comprises a nucleobase sequence according to SEQ ID NO: 16; (q) the sense strand comprises a nucleobase sequence according to SEQ ID NO: 113 and the antisense strand comprises a nucleobase sequence according to SEQ ID NO: 17; (r) the sense strand comprises a nucleobase sequence according to SEQ ID NO: 114 and the antisense strand comprises a nucleobase sequence according to SEQ ID NO: 18; (s) the sense strand comprises a nucleobase sequence according to SEQ ID NO: 115 and the antisense strand comprises a nucleobase sequence according to SEQ ID NO: 19; (t) the sense strand comprises a nucleobase sequence according to SEQ ID NO: 116 and the antisense strand comprises a nucleobase sequence according to SEQ ID NO: 20; (u) the sense strand comprises a nucleobase sequence according to SEQ ID NO: 117 and the antisense strand comprises a nucleobase sequence according to SEQ ID NO: 21; (v) the sense strand comprises a nucleobase sequence according to SEQ ID NO: 118 and the antisense strand comprises a nucleobase sequence according to SEQ ID NO: 22; (w) the sense strand comprises a nucleobase sequence according to SEQ ID NO: 119 and the antisense strand comprises a nucleobase sequence according to SEQ ID NO: 23; (x) the sense strand comprises a nucleobase sequence according to SEQ ID NO: 120 and the antisense strand comprises a nucleobase sequence according to SEQ ID NO: 24; (y) the sense strand comprises a nucleobase sequence according to SEQ ID NO: 121 and the antisense strand comprises a nucleobase sequence according to SEQ ID NO: 25; (z) the sense strand comprises a nucleobase sequence according to SEQ ID NO: 122 and the antisense strand comprises a nucleobase sequence according to SEQ ID NO: 26; (aa) the sense strand comprises a nucleobase sequence according to SEQ ID NO: 123 and the antisense strand comprises a nucleobase sequence according to SEQ ID NO: 27; (bb) the sense strand comprises a nucleobase sequence according to SEQ ID NO: 124 and the antisense strand comprises a nucleobase sequence according to SEQ ID NO: 28; (cc) the sense strand comprises a nucleobase sequence according to SEQ ID NO: 125 and the antisense strand comprises a nucleobase sequence according to SEQ ID NO: 29; (dd) the sense strand comprises a nucleobase sequence according to SEQ ID NO: 126 and the antisense strand comprises a nucleobase sequence according to SEQ ID NO: 30; (ee) the sense strand comprises a nucleobase sequence according to SEQ ID NO: 127 and the antisense strand comprises a nucleobase sequence according to SEQ ID NO: 31; (ff) the sense strand comprises a nucleobase sequence according to SEQ ID NO: 128 and the antisense strand comprises a nucleobase sequence according to SEQ ID NO: 32; (gg) the sense strand comprises a nucleobase sequence according to SEQ ID NO: 129 and the antisense strand comprises a nucleobase sequence according to SEQ ID NO: 33; (hh) the sense strand comprises a nucleobase sequence according to SEQ ID NO: 130 and the antisense strand comprises a nucleobase sequence according to SEQ ID NO: 34; (ii) the sense strand comprises a nucleobase sequence according to SEQ ID NO: 131 and the antisense strand comprises a nucleobase sequence according to SEQ ID NO: 35; (jj) the sense strand comprises a nucleobase sequence according to SEQ ID NO: 132 and the antisense strand comprises a nucleobase sequence according to SEQ ID NO: 36; (kk) the sense strand comprises a nucleobase sequence according to SEQ ID NO: 133 and the antisense strand comprises a nucleobase sequence according to SEQ ID NO: 37; (ll) the sense strand comprises a nucleobase sequence according to SEQ ID NO: 134 and the antisense strand comprises a nucleobase sequence according to SEQ ID NO: 38; (mm) the sense strand comprises a nucleobase sequence according to SEQ ID NO: 135 and the antisense strand comprises a nucleobase sequence according to SEQ ID NO: 39; (nn) the sense strand comprises a nucleobase sequence according to SEQ ID NO: 136 and the antisense strand comprises a nucleobase sequence according to SEQ ID NO: 40; (oo) the sense strand comprises a nucleobase sequence according to SEQ ID NO: 137 and the antisense strand comprises a nucleobase sequence according to SEQ ID NO: 41; (pp) the sense strand comprises a nucleobase sequence according to SEQ ID NO: 138 and the antisense strand comprises a nucleobase sequence according to SEQ ID NO: 42; (qq) the sense strand comprises a nucleobase sequence according to SEQ ID NO: 139 and the antisense strand comprises a nucleobase sequence according to SEQ ID NO: 43; (rr) the sense strand comprises a nucleobase sequence according to SEQ ID NO: 140 and the antisense strand comprises a nucleobase sequence according to SEQ ID NO: 44; (ss) the sense strand comprises a nucleobase sequence according to SEQ ID NO: 141 and the antisense strand comprises a nucleobase sequence according to SEQ ID NO: 45; (tt) the sense strand comprises a nucleobase sequence according to SEQ ID NO: 142 and the antisense strand comprises a nucleobase sequence according to SEQ ID NO: 46; (uu) the sense strand comprises a nucleobase sequence according to SEQ ID NO: 143 and the antisense strand comprises a nucleobase sequence according to SEQ ID NO: 47; (vv) the sense strand comprises a nucleobase sequence according to SEQ ID NO: 144 and the antisense strand comprises a nucleobase sequence according to SEQ ID NO: 48; (ww) the sense strand comprises a nucleobase sequence according to SEQ ID NO: 145 and the antisense strand comprises a nucleobase sequence according to SEQ ID NO: 49; (xx) the sense strand comprises a nucleobase sequence according to SEQ ID NO: 146 and the antisense strand comprises a nucleobase sequence according to SEQ ID NO: 50; (yy) the sense strand comprises a nucleobase sequence according to SEQ ID NO: 147 and the antisense strand comprises a nucleobase sequence according to SEQ ID NO: 51; (zz) the sense strand comprises a nucleobase sequence according to SEQ ID NO: 148 and the antisense strand comprises a nucleobase sequence according to SEQ ID NO: 52; (aaa) the sense strand comprises a nucleobase sequence according to SEQ ID NO: 149 and the antisense strand comprises a nucleobase sequence according to SEQ ID NO: 53; (bbb) the sense strand comprises a nucleobase sequence according to SEQ ID NO: 150 and the antisense strand comprises a nucleobase sequence according to SEQ ID NO: 54; (ccc) the sense strand comprises a nucleobase sequence according to SEQ ID NO: 151 and the antisense strand comprises a nucleobase sequence according to SEQ ID NO: 55; (ddd) the sense strand comprises a nucleobase sequence according to SEQ ID NO: 152 and the antisense strand comprises a nucleobase sequence according to SEQ ID NO: 56; (eee) the sense strand comprises a nucleobase sequence according to SEQ ID NO: 153 and the antisense strand comprises a nucleobase sequence according to SEQ ID NO: 57; (fff) the sense strand comprises a nucleobase sequence according to SEQ ID NO: 154 and the antisense strand comprises a nucleobase sequence according to SEQ ID NO: 58; (ggg) the sense strand comprises a nucleobase sequence according to SEQ ID NO: 155 and the antisense strand comprises a nucleobase sequence according to SEQ ID NO: 59; (hhh) the sense strand comprises a nucleobase sequence according to SEQ ID NO: 156 and the antisense strand comprises a nucleobase sequence according to SEQ ID NO: 60; (iii) the sense strand comprises a nucleobase sequence according to SEQ ID NO: 157 and the antisense strand comprises a nucleobase sequence according to SEQ ID NO: 61; (jjj) the sense strand comprises a nucleobase sequence according to SEQ ID NO: 158 and the antisense strand comprises a nucleobase sequence according to SEQ ID NO: 62; (kkk) the sense strand comprises a nucleobase sequence according to SEQ ID NO: 159 and the antisense strand comprises a nucleobase sequence according to SEQ ID NO: 63; (lll) the sense strand comprises a nucleobase sequence according to SEQ ID NO: 160 and the antisense strand comprises a nucleobase sequence according to SEQ ID NO: 64; (mmm) the sense strand comprises a nucleobase sequence according to SEQ ID NO: 161 and the antisense strand comprises a nucleobase sequence according to SEQ ID NO: 65; (nnn) the sense strand comprises a nucleobase sequence according to SEQ ID NO: 162 and the antisense strand comprises a nucleobase sequence according to SEQ ID NO: 66; (ooo) the sense strand comprises a nucleobase sequence according to SEQ ID NO: 163 and the antisense strand comprises a nucleobase sequence according to SEQ ID NO: 67; (ppp) the sense strand comprises a nucleobase sequence according to SEQ ID NO: 164 and the antisense strand comprises a nucleobase sequence according to SEQ ID NO: 68; (qqq) the sense strand comprises a nucleobase sequence according to SEQ ID NO: 165 and the antisense strand comprises a nucleobase sequence according to SEQ ID NO: 69; (rrr) the sense strand comprises a nucleobase sequence according to SEQ ID NO: 166 and the antisense strand comprises a nucleobase sequence according to SEQ ID NO: 70; (sss) the sense strand comprises a nucleobase sequence according to SEQ ID NO: 167 and the antisense strand comprises a nucleobase sequence according to SEQ ID NO: 71; (ttt) the sense strand comprises a nucleobase sequence according to SEQ ID NO: 168 and the antisense strand comprises a nucleobase sequence according to SEQ ID NO: 72; (uuu) the sense strand comprises a nucleobase sequence according to SEQ ID NO: 169 and the antisense strand comprises a nucleobase sequence according to SEQ ID NO: 73; (vvv) the sense strand comprises a nucleobase sequence according to SEQ ID NO: 170 and the antisense strand comprises a nucleobase sequence according to SEQ ID NO: 74; (www) the sense strand comprises a nucleobase sequence according to SEQ ID NO: 171 and the antisense strand comprises a nucleobase sequence according to SEQ ID NO: 75; (xxx) the sense strand comprises a nucleobase sequence according to SEQ ID NO: 172 and the antisense strand comprises a nucleobase sequence according to SEQ ID NO: 76; (yyy) the sense strand comprises a nucleobase sequence according to SEQ ID NO: 173 and the antisense strand comprises a nucleobase sequence according to SEQ ID NO: 77; (zzz) the sense strand comprises a nucleobase sequence according to SEQ ID NO: 174 and the antisense strand comprises a nucleobase sequence according to SEQ ID NO: 78; (aaaa) the sense strand comprises a nucleobase sequence according to SEQ ID NO: 175 and the antisense strand comprises a nucleobase sequence according to SEQ ID NO: 79; (bbbb) the sense strand comprises a nucleobase sequence according to SEQ ID NO: 176 and the antisense strand comprises a nucleobase sequence according to SEQ ID NO: 80; (cccc) the sense strand comprises a nucleobase sequence according to SEQ ID NO: 177 and the antisense strand comprises a nucleobase sequence according to SEQ ID NO: 81; (dddd) the sense strand comprises a nucleobase sequence according to SEQ ID NO: 178 and the antisense strand comprises a nucleobase sequence according to SEQ ID NO: 82; (eeee) the sense strand comprises a nucleobase sequence according to SEQ ID NO: 179 and the antisense strand comprises a nucleobase sequence according to SEQ ID NO: 83; (ffff) the sense strand comprises a nucleobase sequence according to SEQ ID NO: 180 and the antisense strand comprises a nucleobase sequence according to SEQ ID NO: 84; (gggg) the sense strand comprises a nucleobase sequence according to SEQ ID NO: 181 and the antisense strand comprises a nucleobase sequence according to SEQ ID NO: 85; (hhhh) the sense strand comprises a nucleobase sequence according to SEQ ID NO: 182 and the antisense strand comprises a nucleobase sequence according to SEQ ID NO: 86; (iiii) the sense strand comprises a nucleobase sequence according to SEQ ID NO: 183 and the antisense strand comprises a nucleobase sequence according to SEQ ID NO: 87; (jjjj) the sense strand comprises a nucleobase sequence according to SEQ ID NO: 184 and the antisense strand comprises a nucleobase sequence according to SEQ ID NO: 88; (kkkk) the sense strand comprises a nucleobase sequence according to SEQ ID NO: 185 and the antisense strand comprises a nucleobase sequence according to SEQ ID NO: 89; (llll) the sense strand comprises a nucleobase sequence according to SEQ ID NO: 186 and the antisense strand comprises a nucleobase sequence according to SEQ ID NO: 90; (mmmm) the sense strand comprises a nucleobase sequence according to SEQ ID NO: 187 and the antisense strand comprises a nucleobase sequence according to SEQ ID NO: 91; (nnnn) the sense strand comprises a nucleobase sequence according to SEQ ID NO: 188 and the antisense strand comprises a nucleobase sequence according to SEQ ID NO: 92; (oooo) the sense strand comprises a nucleobase sequence according to SEQ ID NO: 189 and the antisense strand comprises a nucleobase sequence according to SEQ ID NO: 93; (pppp) the sense strand comprises a nucleobase sequence according to SEQ ID NO: 190 and the antisense strand comprises a nucleobase sequence according to SEQ ID NO: 94; (qqqq) the sense strand comprises a nucleobase sequence according to SEQ ID NO: 191 and the antisense strand comprises a nucleobase sequence according to SEQ ID NO: 95; (rrrr) the sense strand comprises a nucleobase sequence according to SEQ ID NO: 192 and the antisense strand comprises a nucleobase sequence according to SEQ ID NO: 96; (ssss) the sense strand comprises a nucleobase sequence according to SEQ ID NO: 458 and the antisense strand comprises a nucleobase sequence according to SEQ ID NO: 385; (tttt) the sense strand comprises a nucleobase sequence according to SEQ ID NO: 459 and the antisense strand comprises a nucleobase sequence according to SEQ ID NO: 386; (uuuu) the sense strand comprises a nucleobase sequence according to SEQ ID NO: 460 and the antisense strand comprises a nucleobase sequence according to SEQ ID NO: 387; (vvvv) the sense strand comprises a nucleobase sequence according to SEQ ID NO: 461 and the antisense strand comprises a nucleobase sequence according to SEQ ID NO: 388; (wwww) the sense strand comprises a nucleobase sequence according to SEQ ID NO: 462 and the antisense strand comprises a nucleobase sequence according to SEQ ID NO: 389; (xxxx) the sense strand comprises a nucleobase sequence according to SEQ ID NO: 463 and the antisense strand comprises a nucleobase sequence according to SEQ ID NO: 390; (yyyy) the sense strand comprises a nucleobase sequence according to SEQ ID NO: 464 and the antisense strand comprises a nucleobase sequence according to SEQ ID NO: 391; (zzzz) the sense strand comprises a nucleobase sequence according to SEQ ID NO: 465 and the antisense strand comprises a nucleobase sequence according to SEQ ID NO: 392; (aaaaa) the sense strand comprises a nucleobase sequence according to SEQ ID NO: 466 and the antisense strand comprises a nucleobase sequence according to SEQ ID NO: 393; (bbbbb) the sense strand comprises a nucleobase sequence according to SEQ ID NO: 467 and the antisense strand comprises a nucleobase sequence according to SEQ ID NO: 394; (ccccc) the sense strand comprises a nucleobase sequence according to SEQ ID NO: 468 and the antisense strand comprises a nucleobase sequence according to SEQ ID NO: 395; (ddddd) the sense strand comprises a nucleobase sequence according to SEQ ID NO: 469 and the antisense strand comprises a nucleobase sequence according to SEQ ID NO: 396; (eeeee) the sense strand comprises a nucleobase sequence according to SEQ ID NO: 470 and the antisense strand comprises a nucleobase sequence according to SEQ ID NO: 397; (fffff) the sense strand comprises a nucleobase sequence according to SEQ ID NO: 471 and the antisense strand comprises a nucleobase sequence according to SEQ ID NO: 398; (ggggg) the sense strand comprises a nucleobase sequence according to SEQ ID NO: 472 and the antisense strand comprises a nucleobase sequence according to SEQ ID NO: 399; (hhhhh) the sense strand comprises a nucleobase sequence according to SEQ ID NO: 473 and the antisense strand comprises a nucleobase sequence according to SEQ ID NO: 400; (iiiii) the sense strand comprises a nucleobase sequence according to SEQ ID NO: 474 and the antisense strand comprises a nucleobase sequence according to SEQ ID NO: 401; (jjjjj) the sense strand comprises a nucleobase sequence according to SEQ ID NO: 475 and the antisense strand comprises a nucleobase sequence according to SEQ ID NO: 402; (kkkkk) the sense strand comprises a nucleobase sequence according to SEQ ID NO: 476 and the antisense strand comprises a nucleobase sequence according to SEQ ID NO: 403; (lllll) the sense strand comprises a nucleobase sequence according to SEQ ID NO: 477 and the antisense strand comprises a nucleobase sequence according to SEQ ID NO: 404; (mmmmm) the sense strand comprises a nucleobase sequence according to SEQ ID NO: 478 and the antisense strand comprises a nucleobase sequence according to SEQ ID NO: 405; (nnnnn) the sense strand comprises a nucleobase sequence according to SEQ ID NO: 479 and the antisense strand comprises a nucleobase sequence according to SEQ ID NO: 406; (ooooo) the sense strand comprises a nucleobase sequence according to SEQ ID NO: 480 and the antisense strand comprises a nucleobase sequence according to SEQ ID NO: 407; (ppppp) the sense strand comprises a nucleobase sequence according to SEQ ID NO: 481 and the antisense strand comprises a nucleobase sequence according to SEQ ID NO: 408; (qqqqq) the sense strand comprises a nucleobase sequence according to SEQ ID NO: 482 and the antisense strand comprises a nucleobase sequence according to SEQ ID NO: 409; (rrrrr) the sense strand comprises a nucleobase sequence according to SEQ ID NO: 483 and the antisense strand comprises a nucleobase sequence according to SEQ ID NO: 410; (sssss) the sense strand comprises a nucleobase sequence according to SEQ ID NO: 484 and the antisense strand comprises a nucleobase sequence according to SEQ ID NO: 411; (ttttt) the sense strand comprises a nucleobase sequence according to SEQ ID NO: 485 and the antisense strand comprises a nucleobase sequence according to SEQ ID NO: 412; (uuuuu) the sense strand comprises a nucleobase sequence according to SEQ ID NO: 486 and the antisense strand comprises a nucleobase sequence according to SEQ ID NO: 413; (vvvvv) the sense strand comprises a nucleobase sequence according to SEQ ID NO: 487 and the antisense strand comprises a nucleobase sequence according to SEQ ID NO: 414; (wwwww) the sense strand comprises a nucleobase sequence according to SEQ ID NO: 488 and the antisense strand comprises a nucleobase sequence according to SEQ ID NO: 415; (xxxxx) the sense strand comprises a nucleobase sequence according to SEQ ID NO: 489 and the antisense strand comprises a nucleobase sequence according to SEQ ID NO: 416; (yyyyy) the sense strand comprises a nucleobase sequence according to SEQ ID NO: 490 and the antisense strand comprises a nucleobase sequence according to SEQ ID NO: 417; (zzzzz) the sense strand comprises a nucleobase sequence according to SEQ ID NO: 491 and the antisense strand comprises a nucleobase sequence according to SEQ ID NO: 418; (aaaaaa) the sense strand comprises a nucleobase sequence according to SEQ ID NO: 492 and the antisense strand comprises a nucleobase sequence according to SEQ ID NO: 419; (bbbbbb) the sense strand comprises a nucleobase sequence according to SEQ ID NO: 493 and the antisense strand comprises a nucleobase sequence according to SEQ ID NO: 420; (cccccc) the sense strand comprises a nucleobase sequence according to SEQ ID NO: 494 and the antisense strand comprises a nucleobase sequence according to SEQ ID NO: 421; (dddddd) the sense strand comprises a nucleobase sequence according to SEQ ID NO: 495 and the antisense strand comprises a nucleobase sequence according to SEQ ID NO: 422; (eeeeee) the sense strand comprises a nucleobase sequence according to SEQ ID NO: 496 and the antisense strand comprises a nucleobase sequence according to SEQ ID NO: 423; (ffffff) the sense strand comprises a nucleobase sequence according to SEQ ID NO: 497 and the antisense strand comprises a nucleobase sequence according to SEQ ID NO: 424; (gggggg) the sense strand comprises a nucleobase sequence according to SEQ ID NO: 498 and the antisense strand comprises a nucleobase sequence according to SEQ ID NO: 425; (hhhhhh) the sense strand comprises a nucleobase sequence according to SEQ ID NO: 499 and the antisense strand comprises a nucleobase sequence according to SEQ ID NO: 426; (iiiiii) the sense strand comprises a nucleobase sequence according to SEQ ID NO: 500 and the antisense strand comprises a nucleobase sequence according to SEQ ID NO: 427; (jjjjjj) the sense strand comprises a nucleobase sequence according to SEQ ID NO: 501 and the antisense strand comprises a nucleobase sequence according to SEQ ID NO: 428; (kkkkkk) the sense strand comprises a nucleobase sequence according to SEQ ID NO: 502 and the antisense strand comprises a nucleobase sequence according to SEQ ID NO: 429; (llllll) the sense strand comprises a nucleobase sequence according to SEQ ID NO: 503 and the antisense strand comprises a nucleobase sequence according to SEQ ID NO: 430; (mmmmmm) the sense strand comprises a nucleobase sequence according to SEQ ID NO: 504 and the antisense strand comprises a nucleobase sequence according to SEQ ID NO: 431; (nnnnnn) the sense strand comprises a nucleobase sequence according to SEQ ID NO: 505 and the antisense strand comprises a nucleobase sequence according to SEQ ID NO: 432; (oooooo) the sense strand comprises a nucleobase sequence according to SEQ ID NO: 506 and the antisense strand comprises a nucleobase sequence according to SEQ ID NO: 433; (pppppp) the sense strand comprises a nucleobase sequence according to SEQ ID NO: 507 and the antisense strand comprises a nucleobase sequence according to SEQ ID NO: 434; (qqqqqq) the sense strand comprises a nucleobase sequence according to SEQ ID NO: 508 and the antisense strand comprises a nucleobase sequence according to SEQ ID NO: 435; (rrrrrr) the sense strand comprises a nucleobase sequence according to SEQ ID NO: 509 and the antisense strand comprises a nucleobase sequence according to SEQ ID NO: 436; (ssssss) the sense strand comprises a nucleobase sequence according to SEQ ID NO: 510 and the antisense strand comprises a nucleobase sequence according to SEQ ID NO: 437; (tttttt) the sense strand comprises a nucleobase sequence according to SEQ ID NO: 511 and the antisense strand comprises a nucleobase sequence according to SEQ ID NO: 438; (uuuuuu) the sense strand comprises a nucleobase sequence according to SEQ ID NO: 512 and the antisense strand comprises a nucleobase sequence according to SEQ ID NO: 439; (vvvvvv) the sense strand comprises a nucleobase sequence according to SEQ ID NO: 513 and the antisense strand comprises a nucleobase sequence according to SEQ ID NO: 440; (wwwwww) the sense strand comprises a nucleobase sequence according to SEQ ID NO: 514 and the antisense strand comprises a nucleobase sequence according to SEQ ID NO: 441; (xxxxxx) the sense strand comprises a nucleobase sequence according to SEQ ID NO: 515 and the antisense strand comprises a nucleobase sequence according to SEQ ID NO: 442; (yyyyyy) the sense strand comprises a nucleobase sequence according to SEQ ID NO: 516 and the antisense strand comprises a nucleobase sequence according to SEQ ID NO: 443; (zzzzzz) the sense strand comprises a nucleobase sequence according to SEQ ID NO: 517 and the antisense strand comprises a nucleobase sequence according to SEQ ID NO: 444; (aaaaaaa) the sense strand comprises a nucleobase sequence according to SEQ ID NO: 518 and the antisense strand comprises a nucleobase sequence according to SEQ ID NO: 445; (bbbbbbb) the sense strand comprises a nucleobase sequence according to SEQ ID NO: 519 and the antisense strand comprises a nucleobase sequence according to SEQ ID NO: 446; (ccccccc) the sense strand comprises a nucleobase sequence according to SEQ ID NO: 520 and the antisense strand comprises a nucleobase sequence according to SEQ ID NO: 447; (ddddddd) the sense strand comprises a nucleobase sequence according to SEQ ID NO: 521 and the antisense strand comprises a nucleobase sequence according to SEQ ID NO: 448; (eeeeeee) the sense strand comprises a nucleobase sequence according to SEQ ID NO: 522 and the antisense strand comprises a nucleobase sequence according to SEQ ID NO: 449; (fffffff) the sense strand comprises a nucleobase sequence according to SEQ ID NO: 523 and the antisense strand comprises a nucleobase sequence according to SEQ ID NO: 450; (ggggggg) the sense strand comprises a nucleobase sequence according to SEQ ID NO: 524 and the antisense strand comprises a nucleobase sequence according to SEQ ID NO: 451; (hhhhhhh) the sense strand comprises a nucleobase sequence according to SEQ ID NO: 525 and the antisense strand comprises a nucleobase sequence according to SEQ ID NO: 452; (iiiiiii) the sense strand comprises a nucleobase sequence according to SEQ ID NO: 526 and the antisense strand comprises a nucleobase sequence according to SEQ ID NO: 453; (jjjjjjj) the sense strand comprises a nucleobase sequence according to SEQ ID NO: 527 and the antisense strand comprises a nucleobase sequence according to SEQ ID NO: 454; (kkkkkkk) the sense strand comprises a nucleobase sequence according to SEQ ID NO: 528 and the antisense strand comprises a nucleobase sequence according to SEQ ID NO: 455; (lllllll) the sense strand comprises a nucleobase sequence according to SEQ ID NO: 529 and the antisense strand comprises a nucleobase sequence according to SEQ ID NO: 456; (mmmmmmm) the sense strand comprises a nucleobase sequence according to SEQ ID NO: 530 and the antisense strand comprises a nucleobase sequence according to SEQ ID NO: 457; (nnnnnnn) the sense strand comprises a nucleobase sequence according to SEQ ID NO: 689 and the antisense strand comprises a nucleobase sequence according to SEQ ID NO: 677; (ooooooo) the sense strand comprises a nucleobase sequence according to SEQ ID NO: 690 and the antisense strand comprises a nucleobase sequence according to SEQ ID NO: 678; (ppppppp) the sense strand comprises a nucleobase sequence according to SEQ ID NO: 691 and the antisense strand comprises a nucleobase sequence according to SEQ ID NO: 679; (qqqqqqq) the sense strand comprises a nucleobase sequence according to SEQ ID NO: 692 and the antisense strand comprises a nucleobase sequence according to SEQ ID NO: 680; (rrrrrrr) the sense strand comprises a nucleobase sequence according to SEQ ID NO: 693 and the antisense strand comprises a nucleobase sequence according to SEQ ID NO: 681; (sssssss) the sense strand comprises a nucleobase sequence according to SEQ ID NO: 694 and the antisense strand comprises a nucleobase sequence according to SEQ ID NO: 682; (ttttttt) the sense strand comprises a nucleobase sequence according to SEQ ID NO: 695 and the antisense strand comprises a nucleobase sequence according to SEQ ID NO: 683; (uuuuuuu) the sense strand comprises a nucleobase sequence according to SEQ ID NO: 696 and the antisense strand comprises a nucleobase sequence according to SEQ ID NO: 684; (vvvvvvv) the sense strand comprises a nucleobase sequence according to SEQ ID NO: 697 and the antisense strand comprises a nucleobase sequence according to SEQ ID NO: 685; (wwwwwww) the sense strand comprises a nucleobase sequence according to SEQ ID NO: 698 and the antisense strand comprises a nucleobase sequence according to SEQ ID NO: 686; (xxxxxxx) the sense strand comprises a nucleobase sequence according to SEQ ID NO: 699 and the antisense strand comprises a nucleobase sequence according to SEQ ID NO: 687; or (yyyyyyy) the sense strand comprises a nucleobase sequence according to SEQ ID NO: 700 and the antisense strand comprises a nucleobase sequence according to SEQ ID NO: 688.

In some implementations of the method or use, (a) the sense strand comprises a nucleobase sequence according to SEQ ID NO: 530 and the antisense strand comprises a nucleobase sequence according to SEQ ID NO: 457; (b) the sense strand comprises a nucleobase sequence according to SEQ ID NO: 523 and the antisense strand comprises a nucleobase sequence according to SEQ ID NO: 450; (c) the sense strand comprises a nucleobase sequence according to SEQ ID NO: 691 and the antisense strand comprises a nucleobase sequence according to SEQ ID NO: 679; (d) the sense strand comprises a nucleobase sequence according to SEQ ID NO: 689 and the antisense strand comprises a nucleobase sequence according to SEQ ID NO: 677; (e) the sense strand comprises a nucleobase sequence according to SEQ ID NO: 522 and the antisense strand comprises a nucleobase sequence according to SEQ ID NO: 449; or (f) the sense strand comprises a nucleobase sequence according to SEQ ID NO: 692 and the antisense strand comprises a nucleobase sequence according to SEQ ID NO: 680.

In some implementations of the method or use, (a) the sense strand comprises a modified nucleotide sequence according to SEQ ID NO: 289 and the antisense strand comprises a modified nucleotide sequence according to SEQ ID NO: 193; (b) the sense strand comprises a modified nucleotide sequence according to SEQ ID NO: 290 and the antisense strand comprises a modified nucleotide sequence according to SEQ ID NO: 194; (c) the sense strand comprises a modified nucleotide sequence according to SEQ ID NO: 291 and the antisense strand comprises a modified nucleotide sequence according to SEQ ID NO: 195; (d) the sense strand comprises a modified nucleotide sequence according to SEQ ID NO: 292 and the antisense strand comprises a modified nucleotide sequence according to SEQ ID NO: 196; (e) the sense strand comprises a modified nucleotide sequence according to SEQ ID NO: 293 and the antisense strand comprises a modified nucleotide sequence according to SEQ ID NO: 197; (f) the sense strand comprises a modified nucleotide sequence according to SEQ ID NO: 294 and the antisense strand comprises a modified nucleotide sequence according to SEQ ID NO: 198; (g) the sense strand comprises a modified nucleotide sequence according to SEQ ID NO: 295 and the antisense strand comprises a modified nucleotide sequence according to SEQ ID NO: 199; (h) the sense strand comprises a modified nucleotide sequence according to SEQ ID NO: 296 and the antisense strand comprises a modified nucleotide sequence according to SEQ ID NO: 200; (i) the sense strand comprises a modified nucleotide sequence according to SEQ ID NO: 297 and the antisense strand comprises a modified nucleotide sequence according to SEQ ID NO: 201; (j) the sense strand comprises a modified nucleotide sequence according to SEQ ID NO: 298 and the antisense strand comprises a modified nucleotide sequence according to SEQ ID NO: 202; (k) the sense strand comprises a modified nucleotide sequence according to SEQ ID NO: 299 and the antisense strand comprises a modified nucleotide sequence according to SEQ ID NO: 203; (l) the sense strand comprises a modified nucleotide sequence according to SEQ ID NO: 300 and the antisense strand comprises a modified nucleotide sequence according to SEQ ID NO: 204; (m) the sense strand comprises a modified nucleotide sequence according to SEQ ID NO: 301 and the antisense strand comprises a modified nucleotide sequence according to SEQ ID NO: 205; (n) the sense strand comprises a modified nucleotide sequence according to SEQ ID NO: 302 and the antisense strand comprises a modified nucleotide sequence according to SEQ ID NO: 206; (o) the sense strand comprises a modified nucleotide sequence according to SEQ ID NO: 303 and the antisense strand comprises a modified nucleotide sequence according to SEQ ID NO: 207; (p) the sense strand comprises a modified nucleotide sequence according to SEQ ID NO: 304 and the antisense strand comprises a modified nucleotide sequence according to SEQ ID NO: 208; (q) the sense strand comprises a modified nucleotide sequence according to SEQ ID NO: 305 and the antisense strand comprises a modified nucleotide sequence according to SEQ ID NO: 209; (r) the sense strand comprises a modified nucleotide sequence according to SEQ ID NO: 306 and the antisense strand comprises a modified nucleotide sequence according to SEQ ID NO: 210; (s) the sense strand comprises a modified nucleotide sequence according to SEQ ID NO: 307 and the antisense strand comprises a modified nucleotide sequence according to SEQ ID NO: 211; (t) the sense strand comprises a modified nucleotide sequence according to SEQ ID NO: 308 and the antisense strand comprises a modified nucleotide sequence according to SEQ ID NO: 212; (u) the sense strand comprises a modified nucleotide sequence according to SEQ ID NO: 309 and the antisense strand comprises a modified nucleotide sequence according to SEQ ID NO: 213; (v) the sense strand comprises a modified nucleotide sequence according to SEQ ID NO: 310 and the antisense strand comprises a modified nucleotide sequence according to SEQ ID NO: 214; (w) the sense strand comprises a modified nucleotide sequence according to SEQ ID NO: 311 and the antisense strand comprises a modified nucleotide sequence according to SEQ ID NO: 215; (x) the sense strand comprises a modified nucleotide sequence according to SEQ ID NO: 312 and the antisense strand comprises a modified nucleotide sequence according to SEQ ID NO: 216; (y) the sense strand comprises a modified nucleotide sequence according to SEQ ID NO: 313 and the antisense strand comprises a modified nucleotide sequence according to SEQ ID NO: 217; (z) the sense strand comprises a modified nucleotide sequence according to SEQ ID NO: 314 and the antisense strand comprises a modified nucleotide sequence according to SEQ ID NO: 218; (aa) the sense strand comprises a modified nucleotide sequence according to SEQ ID NO: 315 and the antisense strand comprises a modified nucleotide sequence according to SEQ ID NO: 219; (bb) the sense strand comprises a modified nucleotide sequence according to SEQ ID NO: 316 and the antisense strand comprises a modified nucleotide sequence according to SEQ ID NO: 220; (cc) the sense strand comprises a modified nucleotide sequence according to SEQ ID NO: 317 and the antisense strand comprises a modified nucleotide sequence according to SEQ ID NO: 221; (dd) the sense strand comprises a modified nucleotide sequence according to SEQ ID NO: 318 and the antisense strand comprises a modified nucleotide sequence according to SEQ ID NO: 222; (ee) the sense strand comprises a modified nucleotide sequence according to SEQ ID NO: 319 and the antisense strand comprises a modified nucleotide sequence according to SEQ ID NO: 223; (ff) the sense strand comprises a modified nucleotide sequence according to SEQ ID NO: 320 and the antisense strand comprises a modified nucleotide sequence according to SEQ ID NO: 224; (gg) the sense strand comprises a modified nucleotide sequence according to SEQ ID NO: 321 and the antisense strand comprises a modified nucleotide sequence according to SEQ ID NO: 225; (hh) the sense strand comprises a modified nucleotide sequence according to SEQ ID NO: 322 and the antisense strand comprises a modified nucleotide sequence according to SEQ ID NO: 226; (ii) the sense strand comprises a modified nucleotide sequence according to SEQ ID NO: 323 and the antisense strand comprises a modified nucleotide sequence according to SEQ ID NO: 227; (jj) the sense strand comprises a modified nucleotide sequence according to SEQ ID NO: 324 and the antisense strand comprises a modified nucleotide sequence according to SEQ ID NO: 228; (kk) the sense strand comprises a modified nucleotide sequence according to SEQ ID NO: 325 and the antisense strand comprises a modified nucleotide sequence according to SEQ ID NO: 229; (ll) the sense strand comprises a modified nucleotide sequence according to SEQ ID NO: 326 and the antisense strand comprises a modified nucleotide sequence according to SEQ ID NO: 230; (mm) the sense strand comprises a modified nucleotide sequence according to SEQ ID NO: 327 and the antisense strand comprises a modified nucleotide sequence according to SEQ ID NO: 231; (nn) the sense strand comprises a modified nucleotide sequence according to SEQ ID NO: 328 and the antisense strand comprises a modified nucleotide sequence according to SEQ ID NO: 232; (oo) the sense strand comprises a modified nucleotide sequence according to SEQ ID NO: 329 and the antisense strand comprises a modified nucleotide sequence according to SEQ ID NO: 233; (pp) the sense strand comprises a modified nucleotide sequence according to SEQ ID NO: 330 and the antisense strand comprises a modified nucleotide sequence according to SEQ ID NO: 234; (qq) the sense strand comprises a modified nucleotide sequence according to SEQ ID NO: 331 and the antisense strand comprises a modified nucleotide sequence according to SEQ ID NO: 235; (rr) the sense strand comprises a modified nucleotide sequence according to SEQ ID NO: 332 and the antisense strand comprises a modified nucleotide sequence according to SEQ ID NO: 236; (ss) the sense strand comprises a modified nucleotide sequence according to SEQ ID NO: 333 and the antisense strand comprises a modified nucleotide sequence according to SEQ ID NO: 237; (tt) the sense strand comprises a modified nucleotide sequence according to SEQ ID NO: 334 and the antisense strand comprises a modified nucleotide sequence according to SEQ ID NO: 238; (uu) the sense strand comprises a modified nucleotide sequence according to SEQ ID NO: 335 and the antisense strand comprises a modified nucleotide sequence according to SEQ ID NO: 239; (vv) the sense strand comprises a modified nucleotide sequence according to SEQ ID NO: 336 and the antisense strand comprises a modified nucleotide sequence according to SEQ ID NO: 240; (ww) the sense strand comprises a modified nucleotide sequence according to SEQ ID NO: 337 and the antisense strand comprises a modified nucleotide sequence according to SEQ ID NO: 241; (xx) the sense strand comprises a modified nucleotide sequence according to SEQ ID NO: 338 and the antisense strand comprises a modified nucleotide sequence according to SEQ ID NO: 242; (yy) the sense strand comprises a modified nucleotide sequence according to SEQ ID NO: 339 and the antisense strand comprises a modified nucleotide sequence according to SEQ ID NO: 243; (zz) the sense strand comprises a modified nucleotide sequence according to SEQ ID NO: 340 and the antisense strand comprises a modified nucleotide sequence according to SEQ ID NO: 244; (aaa) the sense strand comprises a modified nucleotide sequence according to SEQ ID NO: 341 and the antisense strand comprises a modified nucleotide sequence according to SEQ ID NO: 245; (bbb) the sense strand comprises a modified nucleotide sequence according to SEQ ID NO: 342 and the antisense strand comprises a modified nucleotide sequence according to SEQ ID NO: 246; (ccc) the sense strand comprises a modified nucleotide sequence according to SEQ ID NO: 343 and the antisense strand comprises a modified nucleotide sequence according to SEQ ID NO: 247; (ddd) the sense strand comprises a modified nucleotide sequence according to SEQ ID NO: 344 and the antisense strand comprises a modified nucleotide sequence according to SEQ ID NO: 248; (eee) the sense strand comprises a modified nucleotide sequence according to SEQ ID NO: 345 and the antisense strand comprises a modified nucleotide sequence according to SEQ ID NO: 249; (fff) the sense strand comprises a modified nucleotide sequence according to SEQ ID NO: 346 and the antisense strand comprises a modified nucleotide sequence according to SEQ ID NO: 250; (ggg) the sense strand comprises a modified nucleotide sequence according to SEQ ID NO: 347 and the antisense strand comprises a modified nucleotide sequence according to SEQ ID NO: 251; (hhh) the sense strand comprises a modified nucleotide sequence according to SEQ ID NO: 348 and the antisense strand comprises a modified nucleotide sequence according to SEQ ID NO: 252; (iii) the sense strand comprises a modified nucleotide sequence according to SEQ ID NO: 349 and the antisense strand comprises a modified nucleotide sequence according to SEQ ID NO: 253; (jjj) the sense strand comprises a modified nucleotide sequence according to SEQ ID NO: 350 and the antisense strand comprises a modified nucleotide sequence according to SEQ ID NO: 254; (kkk) the sense strand comprises a modified nucleotide sequence according to SEQ ID NO: 351 and the antisense strand comprises a modified nucleotide sequence according to SEQ ID NO: 255; (lll) the sense strand comprises a modified nucleotide sequence according to SEQ ID NO: 352 and the antisense strand comprises a modified nucleotide sequence according to SEQ ID NO: 256; (mmm) the sense strand comprises a modified nucleotide sequence according to SEQ ID NO: 353 and the antisense strand comprises a modified nucleotide sequence according to SEQ ID NO: 257; (nnn) the sense strand comprises a modified nucleotide sequence according to SEQ ID NO: 354 and the antisense strand comprises a modified nucleotide sequence according to SEQ ID NO: 258; (ooo) the sense strand comprises a modified nucleotide sequence according to SEQ ID NO: 355 and the antisense strand comprises a modified nucleotide sequence according to SEQ ID NO: 259; (ppp) the sense strand comprises a modified nucleotide sequence according to SEQ ID NO: 356 and the antisense strand comprises a modified nucleotide sequence according to SEQ ID NO: 260; (qqq) the sense strand comprises a modified nucleotide sequence according to SEQ ID NO: 357 and the antisense strand comprises a modified nucleotide sequence according to SEQ ID NO: 261; (rrr) the sense strand comprises a modified nucleotide sequence according to SEQ ID NO: 358 and the antisense strand comprises a modified nucleotide sequence according to SEQ ID NO: 262; (sss) the sense strand comprises a modified nucleotide sequence according to SEQ ID NO: 359 and the antisense strand comprises a modified nucleotide sequence according to SEQ ID NO: 263; (ttt) the sense strand comprises a modified nucleotide sequence according to SEQ ID NO: 360 and the antisense strand comprises a modified nucleotide sequence according to SEQ ID NO: 264; (uuu) the sense strand comprises a modified nucleotide sequence according to SEQ ID NO: 361 and the antisense strand comprises a modified nucleotide sequence according to SEQ ID NO: 265; (vvv) the sense strand comprises a modified nucleotide sequence according to SEQ ID NO: 362 and the antisense strand comprises a modified nucleotide sequence according to SEQ ID NO: 266; (www) the sense strand comprises a modified nucleotide sequence according to SEQ ID NO: 363 and the antisense strand comprises a modified nucleotide sequence according to SEQ ID NO: 267; (xxx) the sense strand comprises a modified nucleotide sequence according to SEQ ID NO: 364 and the antisense strand comprises a modified nucleotide sequence according to SEQ ID NO: 268; (yyy) the sense strand comprises a modified nucleotide sequence according to SEQ ID NO: 365 and the antisense strand comprises a modified nucleotide sequence according to SEQ ID NO: 269; (zzz) the sense strand comprises a modified nucleotide sequence according to SEQ ID NO: 366 and the antisense strand comprises a modified nucleotide sequence according to SEQ ID NO: 270; (aaaa) the sense strand comprises a modified nucleotide sequence according to SEQ ID NO: 367 and the antisense strand comprises a modified nucleotide sequence according to SEQ ID NO: 271; (bbbb) the sense strand comprises a modified nucleotide sequence according to SEQ ID NO: 368 and the antisense strand comprises a modified nucleotide sequence according to SEQ ID NO: 272; (cccc) the sense strand comprises a modified nucleotide sequence according to SEQ ID NO: 369 and the antisense strand comprises a modified nucleotide sequence according to SEQ ID NO: 273; (dddd) the sense strand comprises a modified nucleotide sequence according to SEQ ID NO: 370 and the antisense strand comprises a modified nucleotide sequence according to SEQ ID NO: 274; (eeee) the sense strand comprises a modified nucleotide sequence according to SEQ ID NO: 371 and the antisense strand comprises a modified nucleotide sequence according to SEQ ID NO: 275; (ffff) the sense strand comprises a modified nucleotide sequence according to SEQ ID NO: 372 and the antisense strand comprises a modified nucleotide sequence according to SEQ ID NO: 276; (gggg) the sense strand comprises a modified nucleotide sequence according to SEQ ID NO: 373 and the antisense strand comprises a modified nucleotide sequence according to SEQ ID NO: 277; (hhhh) the sense strand comprises a modified nucleotide sequence according to SEQ ID NO: 374 and the antisense strand comprises a modified nucleotide sequence according to SEQ ID NO: 278; (iiii) the sense strand comprises a modified nucleotide sequence according to SEQ ID NO: 375 and the antisense strand comprises a modified nucleotide sequence according to SEQ ID NO: 279; (jjjj) the sense strand comprises a modified nucleotide sequence according to SEQ ID NO: 376 and the antisense strand comprises a modified nucleotide sequence according to SEQ ID NO: 280; (kkkk) the sense strand comprises a modified nucleotide sequence according to SEQ ID NO: 377 and the antisense strand comprises a modified nucleotide sequence according to SEQ ID NO: 281; (llll) the sense strand comprises a modified nucleotide sequence according to SEQ ID NO: 378 and the antisense strand comprises a modified nucleotide sequence according to SEQ ID NO: 282; (mmmm) the sense strand comprises a modified nucleotide sequence according to SEQ ID NO: 379 and the antisense strand comprises a modified nucleotide sequence according to SEQ ID NO: 283; (nnnn) the sense strand comprises a modified nucleotide sequence according to SEQ ID NO: 380 and the antisense strand comprises a modified nucleotide sequence according to SEQ ID NO: 284; (oooo) the sense strand comprises a modified nucleotide sequence according to SEQ ID NO: 381 and the antisense strand comprises a modified nucleotide sequence according to SEQ ID NO: 285; (pppp) the sense strand comprises a modified nucleotide sequence according to SEQ ID NO: 382 and the antisense strand comprises a modified nucleotide sequence according to SEQ ID NO: 286; (qqqq) the sense strand comprises a modified nucleotide sequence according to SEQ ID NO: 383 and the antisense strand comprises a modified nucleotide sequence according to SEQ ID NO: 287; (rrrr) the sense strand comprises a modified nucleotide sequence according to SEQ ID NO: 384 and the antisense strand comprises a modified nucleotide sequence according to SEQ ID NO: 288; (ssss) the sense strand comprises a modified nucleobase sequence according to SEQ ID NO: 604 and the antisense strand comprises a modified nucleobase sequence according to SEQ ID NO: 531; (tttt) the sense strand comprises a modified nucleobase sequence according to SEQ ID NO: 605 and the antisense strand comprises a modified nucleobase sequence according to SEQ ID NO: 532; (uuuu) the sense strand comprises a modified nucleobase sequence according to SEQ ID NO: 606 and the antisense strand comprises a modified nucleobase sequence according to SEQ ID NO: 533; (vvvv) the sense strand comprises a modified nucleobase sequence according to SEQ ID NO: 607 and the antisense strand comprises a modified nucleobase sequence according to SEQ ID NO: 534; (wwww) the sense strand comprises a modified nucleobase sequence according to SEQ ID NO: 608 and the antisense strand comprises a modified nucleobase sequence according to SEQ ID NO: 535; (xxxx) the sense strand comprises a modified nucleobase sequence according to SEQ ID NO: 609 and the antisense strand comprises a modified nucleobase sequence according to SEQ ID NO: 536; (yyyy) the sense strand comprises a modified nucleobase sequence according to SEQ ID NO: 610 and the antisense strand comprises a modified nucleobase sequence according to SEQ ID NO: 537; (zzzz) the sense strand comprises a modified nucleobase sequence according to SEQ ID NO: 611 and the antisense strand comprises a modified nucleobase sequence according to SEQ ID NO: 538; (aaaaa) the sense strand comprises a modified nucleobase sequence according to SEQ ID NO: 612 and the antisense strand comprises a modified nucleobase sequence according to SEQ ID NO: 539; (bbbbb) the sense strand comprises a modified nucleobase sequence according to SEQ ID NO: 613 and the antisense strand comprises a modified nucleobase sequence according to SEQ ID NO: 540; (ccccc) the sense strand comprises a modified nucleobase sequence according to SEQ ID NO: 614 and the antisense strand comprises a modified nucleobase sequence according to SEQ ID NO: 541; (ddddd) the sense strand comprises a modified nucleobase sequence according to SEQ ID NO: 615 and the antisense strand comprises a modified nucleobase sequence according to SEQ ID NO: 542; (eeeee) the sense strand comprises a modified nucleobase sequence according to SEQ ID NO: 616 and the antisense strand comprises a modified nucleobase sequence according to SEQ ID NO: 543; (fffff) the sense strand comprises a modified nucleobase sequence according to SEQ ID NO: 617 and the antisense strand comprises a modified nucleobase sequence according to SEQ ID NO: 544; (ggggg) the sense strand comprises a modified nucleobase sequence according to SEQ ID NO: 618 and the antisense strand comprises a modified nucleobase sequence according to SEQ ID NO: 545; (hhhhh) the sense strand comprises a modified nucleobase sequence according to SEQ ID NO: 619 and the antisense strand comprises a modified nucleobase sequence according to SEQ ID NO: 546; (iiiii) the sense strand comprises a modified nucleobase sequence according to SEQ ID NO: 620 and the antisense strand comprises a modified nucleobase sequence according to SEQ ID NO: 547; (jjjjj) the sense strand comprises a modified nucleobase sequence according to SEQ ID NO: 621 and the antisense strand comprises a modified nucleobase sequence according to SEQ ID NO: 548; (kkkkk) the sense strand comprises a modified nucleobase sequence according to SEQ ID NO: 622 and the antisense strand comprises a modified nucleobase sequence according to SEQ ID NO: 549; (lllll) the sense strand comprises a modified nucleobase sequence according to SEQ ID NO: 623 and the antisense strand comprises a modified nucleobase sequence according to SEQ ID NO: 550; (mmmmm) the sense strand comprises a modified nucleobase sequence according to SEQ ID NO: 624 and the antisense strand comprises a modified nucleobase sequence according to SEQ ID NO: 551; (nnnnn) the sense strand comprises a modified nucleobase sequence according to SEQ ID NO: 625 and the antisense strand comprises a modified nucleobase sequence according to SEQ ID NO: 552; (ooooo) the sense strand comprises a modified nucleobase sequence according to SEQ ID NO: 626 and the antisense strand comprises a modified nucleobase sequence according to SEQ ID NO: 553; (ppppp) the sense strand comprises a modified nucleobase sequence according to SEQ ID NO: 627 and the antisense strand comprises a modified nucleobase sequence according to SEQ ID NO: 554; (qqqqq) the sense strand comprises a modified nucleobase sequence according to SEQ ID NO: 628 and the antisense strand comprises a modified nucleobase sequence according to SEQ ID NO: 555; (rrrrr) the sense strand comprises a modified nucleobase sequence according to SEQ ID NO: 629 and the antisense strand comprises a modified nucleobase sequence according to SEQ ID NO: 556; (sssss) the sense strand comprises a modified nucleobase sequence according to SEQ ID NO: 630 and the antisense strand comprises a modified nucleobase sequence according to SEQ ID NO: 557; (ttttt) the sense strand comprises a modified nucleobase sequence according to SEQ ID NO: 631 and the antisense strand comprises a modified nucleobase sequence according to SEQ ID NO: 558; (uuuuu) the sense strand comprises a modified nucleobase sequence according to SEQ ID NO: 632 and the antisense strand comprises a modified nucleobase sequence according to SEQ ID NO: 559; (vvvvv) the sense strand comprises a modified nucleobase sequence according to SEQ ID NO: 633 and the antisense strand comprises a modified nucleobase sequence according to SEQ ID NO: 560; (wwwww) the sense strand comprises a modified nucleobase sequence according to SEQ ID NO: 634 and the antisense strand comprises a modified nucleobase sequence according to SEQ ID NO: 561 (xxxxx) the sense strand comprises a modified nucleobase sequence according to SEQ ID NO: 635 and the antisense strand comprises a modified nucleobase sequence according to SEQ ID NO: 562; (yyyyy) the sense strand comprises a modified nucleobase sequence according to SEQ ID NO: 636 and the antisense strand comprises a modified nucleobase sequence according to SEQ ID NO: 563; (zzzzz) the sense strand comprises a modified nucleobase sequence according to SEQ ID NO: 637 and the antisense strand comprises a modified nucleobase sequence according to SEQ ID NO: 564; (aaaaaa) the sense strand comprises a modified nucleobase sequence according to SEQ ID NO: 638 and the antisense strand comprises a modified nucleobase sequence according to SEQ ID NO: 565; (bbbbbb) the sense strand comprises a modified nucleobase sequence according to SEQ ID NO: 639 and the antisense strand comprises a modified nucleobase sequence according to SEQ ID NO: 566; (cccccc) the sense strand comprises a modified nucleobase sequence according to SEQ ID NO: 640 and the antisense strand comprises a modified nucleobase sequence according to SEQ ID NO: 567; (dddddd) the sense strand comprises a modified nucleobase sequence according to SEQ ID NO: 641 and the antisense strand comprises a modified nucleobase sequence according to SEQ ID NO: 568; (eeeeee) the sense strand comprises a modified nucleobase sequence according to SEQ ID NO: 642 and the antisense strand comprises a modified nucleobase sequence according to SEQ ID NO: 569; (ffffff) the sense strand comprises a modified nucleobase sequence according to SEQ ID NO: 643 and the antisense strand comprises a modified nucleobase sequence according to SEQ ID NO: 570; (gggggg) the sense strand comprises a modified nucleobase sequence according to SEQ ID NO: 644 and the antisense strand comprises a modified nucleobase sequence according to SEQ ID NO: 571; (hhhhhh) the sense strand comprises a modified nucleobase sequence according to SEQ ID NO: 645 and the antisense strand comprises a modified nucleobase sequence according to SEQ ID NO: 572; (iiiiii) the sense strand comprises a modified nucleobase sequence according to SEQ ID NO: 646 and the antisense strand comprises a modified nucleobase sequence according to SEQ ID NO: 573; (jjjjjj) the sense strand comprises a modified nucleobase sequence according to SEQ ID NO: 647 and the antisense strand comprises a modified nucleobase sequence according to SEQ ID NO: 574; (kkkkkk) the sense strand comprises a modified nucleobase sequence according to SEQ ID NO: 648 and the antisense strand comprises a modified nucleobase sequence according to SEQ ID NO: 575; (llllll) the sense strand comprises a modified nucleobase sequence according to SEQ ID NO: 649 and the antisense strand comprises a modified nucleobase sequence according to SEQ ID NO: 576; (mmmmmm) the sense strand comprises a modified nucleobase sequence according to SEQ ID NO: 650 and the antisense strand comprises a modified nucleobase sequence according to SEQ ID NO: 577; (nnnnnn) the sense strand comprises a modified nucleobase sequence according to SEQ ID NO: 651 and the antisense strand comprises a modified nucleobase sequence according to SEQ ID NO: 578; (oooooo) the sense strand comprises a modified nucleobase sequence according to SEQ ID NO: 652 and the antisense strand comprises a modified nucleobase sequence according to SEQ ID NO: 579; (pppppp) the sense strand comprises a modified nucleobase sequence according to SEQ ID NO: 653 and the antisense strand comprises a modified nucleobase sequence according to SEQ ID NO: 580; (qqqqqq) the sense strand comprises a modified nucleobase sequence according to SEQ ID NO: 654 and the antisense strand comprises a modified nucleobase sequence according to SEQ ID NO: 581; (rrrrrr) the sense strand comprises a modified nucleobase sequence according to SEQ ID NO: 655 and the antisense strand comprises a modified nucleobase sequence according to SEQ ID NO: 582; (ssssss) the sense strand comprises a modified nucleobase sequence according to SEQ ID NO: 656 and the antisense strand comprises a modified nucleobase sequence according to SEQ ID NO: 583; (tttttt) the sense strand comprises a modified nucleobase sequence according to SEQ ID NO: 657 and the antisense strand comprises a modified nucleobase sequence according to SEQ ID NO: 584; (uuuuuu) the sense strand comprises a modified nucleobase sequence according to SEQ ID NO: 658 and the antisense strand comprises a modified nucleobase sequence according to SEQ ID NO: 585; (vvvvvv) the sense strand comprises a modified nucleobase sequence according to SEQ ID NO: 659 and the antisense strand comprises a modified nucleobase sequence according to SEQ ID NO: 586; (wwwwww) the sense strand comprises a modified nucleobase sequence according to SEQ ID NO: 660 and the antisense strand comprises a modified nucleobase sequence according to SEQ ID NO: 587; (xxxxxx) the sense strand comprises a modified nucleobase sequence according to SEQ ID NO: 661 and the antisense strand comprises a modified nucleobase sequence according to SEQ ID NO: 588; (yyyyyy) the sense strand comprises a modified nucleobase sequence according to SEQ ID NO: 662 and the antisense strand comprises a modified nucleobase sequence according to SEQ ID NO: 589; (zzzzzz) the sense strand comprises a modified nucleobase sequence according to SEQ ID NO: 663 and the antisense strand comprises a modified nucleobase sequence according to SEQ ID NO: 590; (aaaaaaa) the sense strand comprises a modified nucleobase sequence according to SEQ ID NO: 664 and the antisense strand comprises a modified nucleobase sequence according to SEQ ID NO: 591; (bbbbbbb) the sense strand comprises a modified nucleobase sequence according to SEQ ID NO: 665 and the antisense strand comprises a modified nucleobase sequence according to SEQ ID NO: 592; (ccccccc) the sense strand comprises a modified nucleobase sequence according to SEQ ID NO: 666 and the antisense strand comprises a modified nucleobase sequence according to SEQ ID NO: 593; (ddddddd) the sense strand comprises a modified nucleobase sequence according to SEQ ID NO: 667 and the antisense strand comprises a modified nucleobase sequence according to SEQ ID NO: 594; (eeeeeee) the sense strand comprises a modified nucleobase sequence according to SEQ ID NO: 668 and the antisense strand comprises a modified nucleobase sequence according to SEQ ID NO: 595; (fffffff) the sense strand comprises a modified nucleobase sequence according to SEQ ID NO: 669 and the antisense strand comprises a modified nucleobase sequence according to SEQ ID NO: 596; (ggggggg) the sense strand comprises a modified nucleobase sequence according to SEQ ID NO: 670 and the antisense strand comprises a modified nucleobase sequence according to SEQ ID NO: 597; (hhhhhhh) the sense strand comprises a modified nucleobase sequence according to SEQ ID NO: 671 and the antisense strand comprises a modified nucleobase sequence according to SEQ ID NO: 598; (iiiiiii) the sense strand comprises a modified nucleobase sequence according to SEQ ID NO: 672 and the antisense strand comprises a modified nucleobase sequence according to SEQ ID NO: 599; (jjjjjjj) the sense strand comprises a modified nucleobase sequence according to SEQ ID NO: 673 and the antisense strand comprises a modified nucleobase sequence according to SEQ ID NO: 600; (kkkkkkk) the sense strand comprises a modified nucleobase sequence according to SEQ ID NO: 674 and the antisense strand comprises a modified nucleobase sequence according to SEQ ID NO: 601; (lllllll) the sense strand comprises a modified nucleobase sequence according to SEQ ID NO: 675 and the antisense strand comprises a modified nucleobase sequence according to SEQ ID NO: 602; (mmmmmmm) the sense strand comprises a modified nucleobase sequence according to SEQ ID NO: 676 and the antisense strand comprises a modified nucleobase sequence according to SEQ ID NO: 603; (nnnnnnn) the sense strand comprises a modified nucleobase sequence according to SEQ ID NO: 713 and the antisense strand comprises a modified nucleobase sequence according to SEQ ID NO: 701; (ooooooo) the sense strand comprises a modified nucleobase sequence according to SEQ ID NO: 714 and the antisense strand comprises a modified nucleobase sequence according to SEQ ID NO: 702; (ppppppp) the sense strand comprises a modified nucleobase sequence according to SEQ ID NO: 715 and the antisense strand comprises a modified nucleobase sequence according to SEQ ID NO: 703; (qqqqqqq) the sense strand comprises a modified nucleobase sequence according to SEQ ID NO: 716 and the antisense strand comprises a modified nucleobase sequence according to SEQ ID NO: 704; (rrrrrrr) the sense strand comprises a modified nucleobase sequence according to SEQ ID NO: 717 and the antisense strand comprises a modified nucleobase sequence according to SEQ ID NO: 705; (sssssss) the sense strand comprises a modified nucleobase sequence according to SEQ ID NO: 718 and the antisense strand comprises a modified nucleobase sequence according to SEQ ID NO: 706; (ttttttt) the sense strand comprises a modified nucleobase sequence according to SEQ ID NO: 719 and the antisense strand comprises a modified nucleobase sequence according to SEQ ID NO: 707; (uuuuuuu) the sense strand comprises a modified nucleobase sequence according to SEQ ID NO: 720 and the antisense strand comprises a modified nucleobase sequence according to SEQ ID NO: 708; (vvvvvvv) the sense strand comprises a modified nucleobase sequence according to SEQ ID NO: 721 and the antisense strand comprises a modified nucleobase sequence according to SEQ ID NO: 709; (wwwwwww) the sense strand comprises a modified nucleobase sequence according to SEQ ID NO: 722 and the antisense strand comprises a modified nucleobase sequence according to SEQ ID NO: 710; (xxxxxxx) the sense strand comprises a modified nucleobase sequence according to SEQ ID NO: 723 and the antisense strand comprises a modified nucleobase sequence according to SEQ ID NO: 711; (yyyyyyy) the sense strand comprises a modified nucleobase sequence according to SEQ ID NO: 724 and the antisense strand comprises a modified nucleobase sequence according to SEQ ID NO: 712; (aaaaaaaa) the sense strand comprises a modified nucleobase sequence according to SEQ ID NO: 726 and the antisense strand comprises a modified nucleobase sequence according to SEQ ID NO: 603; (bbbbbbbb) the sense strand comprises a modified nucleobase sequence according to SEQ ID NO: 727 and the antisense strand comprises a modified nucleobase sequence according to SEQ ID NO: 596; (cccccccc) the sense strand comprises a modified nucleobase sequence according to SEQ ID NO: 728 and the antisense strand comprises a modified nucleobase sequence according to SEQ ID NO: 703; (dddddddd) the sense strand comprises a modified nucleobase sequence according to SEQ ID NO: 729 and the antisense strand comprises a modified nucleobase sequence according to SEQ ID NO: 701; (eeeeeeee) the sense strand comprises a modified nucleobase sequence according to SEQ ID NO: 730 and the antisense strand comprises a modified nucleobase sequence according to SEQ ID NO: 595; or (ffffffff) the sense strand comprises a modified nucleobase sequence according to SEQ ID NO: 731 and the antisense strand comprises a modified nucleobase sequence according to SEQ ID NO: 704.

In some implementations of the method or use, (a) the sense strand comprises a modified nucleobase sequence according to SEQ ID NO: 676 and the antisense strand comprises a modified nucleobase sequence according to SEQ ID NO: 603; (b) the sense strand comprises a modified nucleobase sequence according to SEQ ID NO: 669 and the antisense strand comprises a modified nucleobase sequence according to SEQ ID NO: 596; (c) the sense strand comprises a modified nucleobase sequence according to SEQ ID NO: 715 and the antisense strand comprises a modified nucleobase sequence according to SEQ ID NO: 703; (d) the sense strand comprises a modified nucleobase sequence according to SEQ ID NO: 713 and the antisense strand comprises a modified nucleobase sequence according to SEQ ID NO: 701; (e) the sense strand comprises a modified nucleobase sequence according to SEQ ID NO: 668 and the antisense strand comprises a modified nucleobase sequence according to SEQ ID NO: 595; (f) the sense strand comprises a modified nucleobase sequence according to SEQ ID NO: 716 and the antisense strand comprises a modified nucleobase sequence according to SEQ ID NO: 704; (g) the sense strand comprises a modified nucleobase sequence according to SEQ ID NO: 726 and the antisense strand comprises a modified nucleobase sequence according to SEQ ID NO: 603; (h) the sense strand comprises a modified nucleobase sequence according to SEQ ID NO: 727 and the antisense strand comprises a modified nucleobase sequence according to SEQ ID NO: 596; (i) the sense strand comprises a modified nucleobase sequence according to SEQ ID NO: 728 and the antisense strand comprises a modified nucleobase sequence according to SEQ ID NO: 703; (j) the sense strand comprises a modified nucleobase sequence according to SEQ ID NO: 729 and the antisense strand comprises a modified nucleobase sequence according to SEQ ID NO: 701; (k) the sense strand comprises a modified nucleobase sequence according to SEQ ID NO: 730 and the antisense strand comprises a modified nucleobase sequence according to SEQ ID NO: 595; or (l) the sense strand comprises a modified nucleobase sequence according to SEQ ID NO: 731 and the antisense strand comprises a modified nucleobase sequence according to SEQ ID NO: 704. In some implementations, the RNAi agent comprises a targeting ligand comprising a structure according to Formula I:

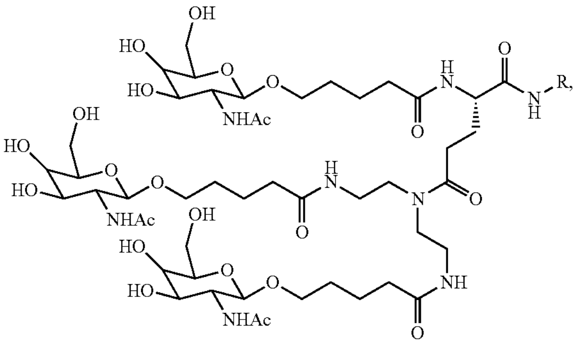

wherein R is a linker conjugated to the wherein the targeting ligand is conjugated to 3' end of the sense strand, wherein R comprises a structure according to Formula III:

Formula III

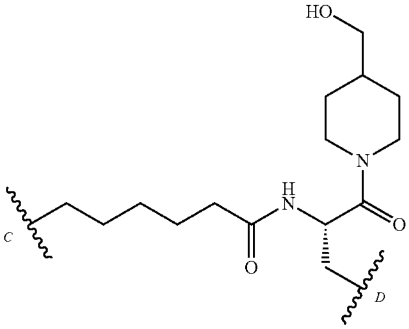

and wherein connection point C of Formula III is conjugated to Formula I, and connection point D of Formula III is conjugated to the 3' end of the sense strand.

In some implementations of the method or use, the sense strand comprises a 3' overhang of 1-5 nucleotides in length. In some implementations of the method or use, the sense strand comprises a 5' overhang of 1-5 nucleotides in length. In some implementations of the method or use, the antisense strand comprises a 3' overhang of 1-5 nucleotides in length. In some implementations of the method or use, the antisense strand comprises a 5' overhang of 1-5 nucleotides in length.

In some implementations of the method or use, the sense strand or the antisense strand comprises at least one modified nucleotide or at least one modified internucleoside linkage. In some implementations of the method or use, the sense strand and or the antisense strand comprises a modified internucleoside linkage at a first, second, penultimate, or final internucleoside linkage position. In some implementations of the method or use, the at least one modified nucleotide or at least one modified internucleoside linkage comprises a 2'-O-methyl modified nucleotide, a nucleotide comprising a 5'-phosphorothioate group, a 2'-deoxy-2'-fluoro modified nucleotide, a 2'-deoxy-modified nucleotide, a locked nucleotide, an abasic nucleotide, deoxythymidine, an inverted deoxythymidine, a 2'-amino-modified nucleotide, a 2'-alkyl-modified nucleotide, a morpholino nucleotide, a phosphoramidate, or a non-natural base comprising nucleotide.

In some implementations of the method or use, the targeting ligand is conjugated to the sense strand.

In some implementations of the method or use, the targeting ligand is conjugated to the 3' end of the sense strand. In some implementations of the method or use, the targeting ligand is conjugated to the 5' end of the sense strand. In some implementations of the method or use, the targeting ligand is conjugated to the antisense strand. In some implementations of the method or use, the targeting ligand is conjugated to the 3' end of the antisense strand. In some implementations of the method or use, the targeting ligand is conjugated to the 5' end of the antisense strand. In some implementations of the method or use, the targeting ligand comprises a galactose trimer. In some implementations of the method or use, the targeting ligand comprises N-acetylgalactosamine (GalNac). In some implementations of the method or use, the targeting ligand comprises a structure according to Formula I:

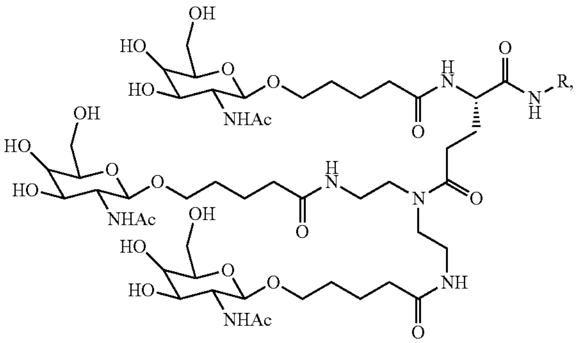

wherein R is:

(i) the sense strand or the antisense strand; or (ii) a linker conjugated to the sense strand or the antisense strand. In some implementations of the method or use, R is a linker conjugated to the sense strand or the antisense strand having a structure according to Formula III:

Formula III

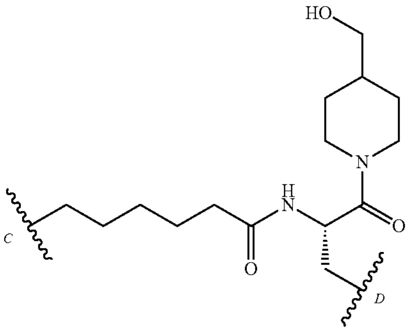

wherein:

(i) connection point C of Formula III is conjugated to Formula I, and connection point D of Formula III is conjugated to the sense strand or the antisense strand; or (ii) connection point C of Formula III is conjugated to Formula I, and connection point D of Formula III is conjugated to a phosphate group which is conjugated to the sense strand or the antisense strand. In some implementations of the method or use, Formula III or the phosphate group is conjugated to the 3' end or 5' end of the sense strand or the antisense strand. In some implementations of the method or use, Formula III or the phosphate group is conjugated to an internal nucleotide or nucleoside base of the sense strand or the antisense strand.

In some implementations of the method or use, RNAi agent comprises a targeting ligand and linker according to Formula V:

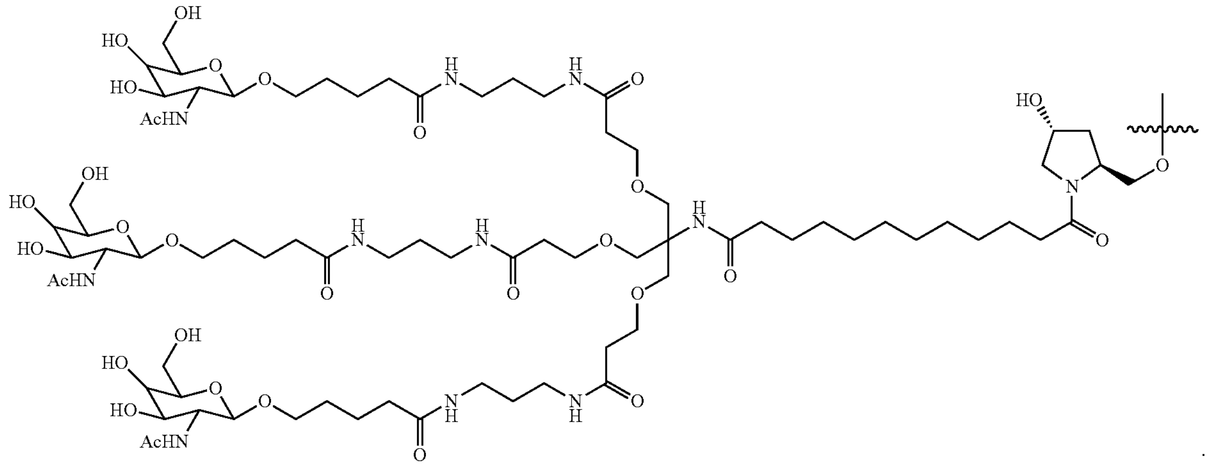 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

In some implementations of the method or use, the RNAi agent is an siRNA molecule. In some implementations of the method or use, the RNAi agent is an shRNA molecule.

Further described herein is a method of producing the RNAi agent as described herein, comprising annealing together the sense strand and the antisense strand. In some implementations, the method further comprises synthesizing the antisense strand and/or the sense strand.

DETAILED DESCRIPTION

Figure 1:
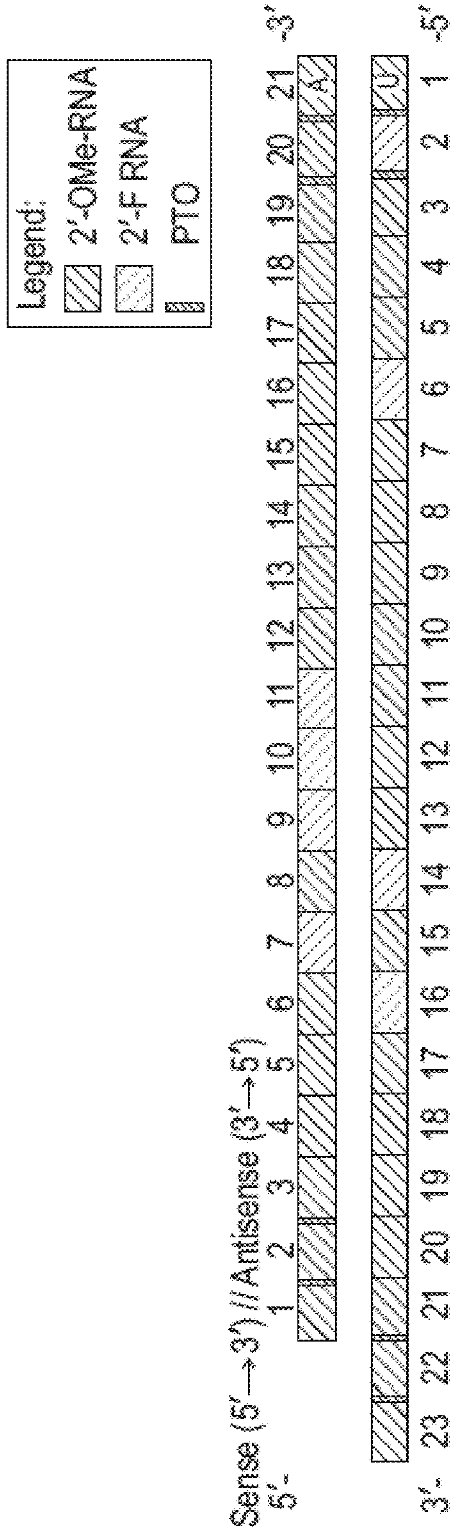
FIG. 1 depicts a schematic illustrating the modifications of an exemplary modified sequence relative to an unmodified sequence.

Provided herein are inhibitory nucleic acids (e.g. RNAi agents) to block gene expression in a highly conserved regulatory mechanism known as RNA interference. RNAi agents comprise short interfering RNA (siRNA) and short hairpin RNA (shRNA). The interfering RNA can be assembled from two separate oligonucleotides, where one strand is the sense strand and the other is the antisense strand, wherein the antisense and sense strands are self-complementary; the antisense strand comprises nucleotide sequence that is complementary to a nucleotide sequence in a target nucleic acid molecule or a portion thereof and the sense strand comprises nucleotide sequence corresponding to the target nucleic acid sequence or a portion thereof. In some embodiments, the nucleic acid targeted by the RNAi may produce an unwanted protein wherein its inhibition would result in a therapeutic benefit.

Insulin receptor substrate-1 (IRS1) encodes a protein which is phosphorylated by insulin receptor tyrosine kinase and appears to have a central role in the insulin-stimulated signal transduction pathway. The IRS proteins transmit signals from the insulin and IGF-1 receptors to elicit a cellular response.

Mutations in the IRS1 gene are associated with type II diabetes and susceptibility to insulin resistance. Additionally, the IRS1 gene may be associated with nonalcoholic fatty liver disease (NAFLD) and/or nonalcoholic steatohepatitis (NASH). In addition to a variety of other disorders, insulin resistance and hyperinsulinemia are primary abnormalities in NAFLD and NASH (Neuschwander-Tetri, B. A. and S. H. Caldwell (2003) *Hepatology* 37 (5): 1202-1209; Sanyal, A. J. (2001) *Am. J. Gastroenterol.* 96 (2): 274-276). A common feature in these disorders is abnormal fat metabolism and/or mitochondrial injury or dysfunction. Previously, the major mechanism of insulin resistance was thought to be the downregulation of IRS1 signaling by excess free fatty acids which impair the tyrosine phosphorylation of IRS1 (see, e.g., US20090304704A1). Accordingly, the downregulation of IRS1 signaling was expected to result in NAFLD and NASH disorders.

The present invention is based, in part, on the inventor's surprising finding that inhibition of IRS1 mRNA expression by RNAi agents targeting the IRS1 gene results in a reduction of liver fat in mice. Such control and reduction of liver fat is unexpected in view of the prior literature teachings that IRS1 inhibition causes NAFLD and NASH disorders, which are characterized by abnormal fat metabolism.

Provided herein are RNAi agents and compositions designed to target the IRS1 gene and inhibit the production of IRS1 mRNA expression. Also described herein are methods of using the RNAi agents or compositions thereof in treating or ameliorating nonalcoholic fatty liver disease (NAFLD). Also described herein are methods of using the RNAi agents or compositions thereof in treating or ameliorating nonalcoholic steatohepatitis (NASH).

I. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

As used herein, the singular forms "a," "an," and "the" include plural referents unless the context clearly dictates otherwise. For example, "a" or "an" means "at least one" or "one or more." It is understood that aspects, embodiments, and variations described herein include "comprising," "consisting," and/or "consisting essentially of" aspects, embodiments and variations.

The term "about" as used herein refers to the usual error range for the respective value readily known to the skilled person in this technical field. Reference to "about" a value or parameter herein includes (and describes) embodiments that are directed to that value or parameter per se. For example, description referring to "about X" includes description of "X".

The term "controlling" as used herein, in reference to a liver fat accumulation in a subject, is understood to mean reducing an increase in an amount of liver fat accumulation compared to an untreated subject. Controlling can include preventing an increase in an amount of liver fat.

As used herein, the term "nucleic acid" refers to a polymer or oligomer of nucleotides. Nucleic acids are also referred as "ribonucleic acids" when the sugar moiety of the nucleotides is D-ribose and as "deoxyribonucleic acids" when the sugar moiety is 2-deoxy-D-ribose.

As used herein, the term "nucleotide" usually refers to a compound consisting of a nucleoside esterified to a monophosphate, polyphosphate, or phosphate-derivative group via the hydroxyl group of the 5-carbon of the sugar moiety. Nucleotides are also referred as "ribonucleotides" when the sugar moiety is D-ribose and as "deoxyribonucleotides" when the sugar moiety is 2-deoxy-D-ribose.

As used herein, the term "nucleoside" refers to a glycosylamine consisting of a nucleobase, such as a purine or pyrimidine, usually linked to a 5-carbon sugar (e.g. D-ribose or 2-deoxy-D-ribose) via a β-glycosidic linkage. Nucleosides are also referred as "ribonucleosides" when the sugar moiety is D-ribose and as "deoxyribonucleosides" when the sugar moiety is 2-deoxy-D-ribose.

As used herein, the term "nucleobase", refers to a compound containing a nitrogen atom that has the chemical properties of a base. Non-limiting examples of nucleobases are compounds comprising pyridine, purine, or pyrimidine moieties, including, but not limited to adenine, guanine, hypoxanthine, thymine, cytosine, and uracil.

As used herein, the term "nucleotide sequences" encompasses nucleotide sequences with no modified nucleotides and nucleotide sequences with modified nucleotides. The latter are referred to as "modified nucleotide sequences" or simply "modified sequences."

As used herein, the term "modified nucleotide" is a nucleotide other than a ribonucleotide (2'-hydroxyl nucleotide).

As used herein, the following notations are used to indicate modified nucleotides, targeting groups, and linking groups. As the person of ordinary skill in the art would readily understand, unless otherwise indicated by the sequence, that when present in an oligonucleotide, the monomers are mutually linked by 5'-3'-phosphodiester bonds:

A=adenosine-3'-phosphate;
C=cytidine-3'-phosphate;
G=guanosine-3'-phosphate;
U=uridine-3'-phosphate
n=any 2'-OMe modified nucleotide
a=2'-O-methyladenosine-3'-phosphate
as=2'-O-methyladenosine-3'-phosphorothioate
c=2'-O-methylcytidine-3'-phosphate
cs=2'-O-methylcytidine-3'-phosphorothioate
g=2'-O-methylguanosine-3'-phosphate
gs=2'-O-methylguanosine-3'-phosphorothioate
t=2'-O-methyl-5-methyluridine-3'-phosphate
ts=2'-O-methyl-5-methyluridine-3'-phosphorothioate
u=2'-O-methyluridine-3'-phosphate
us=2'-O-methyluridine-3'-phosphorothioate
Nf=any 2'-fluoro modified nucleotide
Nfs=any 2'-fluoro modified nucleotide with 3'-phosporothioate
Af=2'-fluoroadenosine-3'-phosphate Afs=2'-fluoroadenosine-3'-phosporothioate
Cf=2'-fluorocytidine-3'-phosphate
Cfs=2'-fluorocytidine-3'-phosphorothioate
Gf=2'-fluoroguanosine-3'-phosphate
Gfs=2'-fluoroguanosine-3'-phosphorothioate
Tf=2'-fluoro-5'-methyluridine-3'-phosphate
Tfs=2'-fluoro-5'-methyluridine-3'-phosphorothioate
Uf=2'-fluorouridine-3'-phosphate
Ufs=2'-fluorouridine-3'-phosphorothioate
dN=any 2'-deoxyribonucleotide
dT=2'-deoxythymidine-3'-phosphate
NUNA=2',3'-seco nucleotide mimics (unlocked nucleobase analogs)
NLNA=locked nucleotide
NANA=2'-F-Arabino nucleotide
NM=2'-methoxyethyl nucleotide
AM=2'-methoxyethyladenosine-3'-phosphate
AMs=2'-methoxyethyladenosine-3'-phosphorothioate
TM=2'-methoxyethylthymidine-3'-phosphate
TMs=2'-methoxyethylthymidine-3'-phosphorothioate
R=ribitol
(invdN)=any inverted deoxyribonucleotide (3'-3' linked nucleotide)
(invAb)=inverted (3'-3' linked) abasic deoxyribonucleotide, see Table 4
(invAb)s=inverted (3'-3' linked) abasic deoxyribonucleotide-5'-phosphorothioate, see Table 4
(invn)=any inverted 2'-OMe nucleotide (3'-3' linked nucleotide)
s=phosphorothioate linkage
vpdN=vinyl phosphonate deoxyribonucleotide
(5Me-Nf)=5'-Me, 2'-fluoro nucleotide
cPrp=cyclopropyl phosphonate, see Table 4
epTcPr=see Table 4
epTM=see Table 4

As used herein, an "RNAi agent" means a composition that contains an RNA or RNA-like (e.g., chemically modified RNA) oligonucleotide molecule that is capable of degrading or inhibiting translation of messenger RNA (mRNA) transcripts of a target mRNA in a sequence specific manner. As used herein, RNAi agents may operate through the RNA interference mechanism (i.e., inducing RNA interference through interaction with the RNA interference pathway machinery (RNA-induced silencing complex or RISC) of mammalian cells), or by any alternative mechanism(s) or pathway(s). While it is believed that RNAi agents, as that term is used herein, operate primarily through the RNA interference mechanism, the disclosed RNAi agents are not bound by or limited to any particular pathway or mechanism of action. RNAi agents disclosed herein are comprised of a sense strand and an antisense strand, and include, but are not limited to: short interfering RNAs (siRNAs), double-stranded RNAs (dsRNA), micro RNAs (miRNAs), short hairpin RNAs (shRNA), and dicer substrates. The antisense strand of the RNAi agents described herein is at least partially complementary to the mRNA being targeted.

As used herein, and unless otherwise indicated, the term "complementary," when used to describe a first nucleotide sequence (e.g., RNAi agent sense strand or targeted mRNA) in relation to a second nucleotide sequence (e.g., RNAi agent antisense strand or a single-stranded antisense oligonucleotide), means the ability of an oligonucleotide or polynucleotide including the first nucleotide sequence to hybridize (form base pair hydrogen bonds under mammalian physiological conditions (or similar conditions in vitro)) and form a duplex or double helical structure under certain conditions with an oligonucleotide or polynucleotide including the second nucleotide sequence. Complementary sequences include Watson-Crick base pairs or non-Watson-Crick base pairs and include natural or modified nucleotides or nucleotide mimics, at least to the extent that the above hybridization requirements are fulfilled. Sequence identity or complementarity is independent of modification. For example, a and Af are complementary to U (or T) and identical to A for the purposes of determining identity or complementarity.

As used herein, "partially complementary" means that in a hybridized pair of nucleobase sequences, at least 70%, but not all, of the bases in a contiguous sequence of a first polynucleotide will hybridize with the same number of bases in a contiguous sequence of a second polynucleotide.

As used herein, "treatment" (and grammatical variations thereof such as "treat" or "treating") refers to complete or partial amelioration or reduction of a disease or condition or disorder, or a symptom, adverse effect or outcome, or phenotype associated therewith. Desirable effects of treatment include, but are not limited to, preventing recurrence of disease, alleviation of symptoms, diminishment of any direct or indirect pathological consequences of the disease, decreasing the rate of disease progression, amelioration or palliation of the disease state, and remission or improved prognosis. The terms do not require complete curing of a disease or complete elimination of any symptom or effect(s) on all symptoms or outcomes.

As used herein, "delaying development of a disease" means to defer, hinder, slow, retard, stabilize, suppress and/or postpone development of the disease (such as non-alcoholic fatty liver disease (NAFLD) and/or nonalcoholic steatohepatitis (NASH)). This delay can be of varying lengths of time, depending on the history of the disease and/or subject being treated. As sufficient or significant delay can, in effect, encompass prevention, in that the subject does not develop the disease.

"Preventing," as used herein, includes providing prophylaxis with respect to the occurrence or recurrence of a disease in a subject that may be predisposed to the disease but has not yet been diagnosed with the disease. In some embodiments, the provided RNAi agent and compositions are used to delay development of a disease or to slow the progression of a disease.

An "effective amount" of an agent, e.g., a pharmaceutical formulation, RNAi agent, or composition, in the context of administration, refers to an amount effective, at dosages/amounts and for periods of time necessary, to achieve a desired result, such as a therapeutic or prophylactic result.

A "therapeutically effective amount" of an agent, e.g., a pharmaceutical formulation, RNAi agent, or composition refers to an amount effective, at dosages and for periods of time necessary, to achieve a desired therapeutic result, such as for treatment of a disease, condition, or disorder, and/or pharmacokinetic or pharmacodynamic effect of the treatment. The therapeutically effective amount may vary according to factors such as the disease state, age, sex, and weight of the subject. In some embodiments, the provided methods involve administering the RNAi agent and/or compositions at effective amounts, e.g., therapeutically effective amounts.

As used herein, a "subject" or an "individual" is a mammal. In some embodiments, a "mammal" includes humans, non-human primates, domestic and farm animals, and zoo, sports, or pet animals, such as dogs, horses, rabbits, cattle, pigs, hamsters, gerbils, mice, ferrets, rats, cats, monkeys, etc. In some embodiments, the subject is human.

Throughout this disclosure, various aspects of the claimed subject matter are presented in a range format. It should be understood that the description in range format is merely for convenience and brevity and should not be construed as an inflexible limitation on the scope of the claimed subject matter. Accordingly, the description of a range should be considered to have specifically disclosed all the possible sub-ranges as well as individual numerical values within that range. For example, where a range of values is provided, it is understood that each intervening value, between the upper and lower limit of that range and any other stated or intervening value in that stated range is encompassed within the claimed subject matter. The upper and lower limits of these smaller ranges may independently be included in the smaller ranges, and are also encompassed within the claimed subject matter, subject to any specifically excluded limit in the stated range. Where the stated range includes one or both of the limits, ranges excluding either or both of those included limits are also included in the claimed subject matter. This applies regardless of the breadth of the range.

All publications, including patent documents, scientific articles and databases, referred to in this application are incorporated by reference in their entirety for all purposes to the same extent as if each individual publication were individually incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

II. RNAI AGENTS

Provided herein are inhibitory nucleic acids produced to inhibit the expression of insulin receptor substrate-1 (IRS1). In some embodiments, the inhibitory nucleic acids described herein include modified oligonucleotides, oligomeric duplexes, antisense oligonucleotides (ASOs), ribozymes, external guide sequence (EGS) oligonucleotides, siRNA compounds, single- or double-stranded RNA interference (RNAi) compounds such as siRNA compounds, modified bases/locked nucleic acids (LNAs), antagomirs, peptide nucleic acids (PNAs), and other oligomeric compounds or oligonucleotide mimetics which hybridize to at least a portion of insulin receptor substrate-1 (IRS1) and modulate its function. In some embodiments, the inhibitory nucleic acids include antisense RNA, antisense DNA, chimeric antisense oligonucleotides, antisense oligonucleotides comprising modified linkages, interference RNA (RNAi), short interfering RNA (siRNA); a micro, interfering RNA (miRNA); a small, temporal RNA (stRNA); or a short, hairpin RNA (shRNA); small RNA-induced gene activation (RNAa); small activating RNAs (saRNAs), or combinations thereof. In a specific embodiment, the inhibitory nucleic acid is an interference RNA (RNAi).

In some embodiments, the inhibitory agent is a modified oligonucleotide. In some embodiments, the modified oligonucleotide consists of 10 to 50 linked nucleosides, 10 to 30 linked nucleosides, 12 to 30 linked nucleosides, 15 to 50 linked nucleosides, 20 to 50 linked nucleosides, or 12 to 50 linked nucleosides. In an exemplary embodiments, the modified oligonucleotide consists of between 12 to 30 or 12 to 50 linked nucleosides. In some embodiments, the modified oligonucleotide includes at least one synthetically modified internucleoside linkage. In some embodiments, the modified oligonucleotide includes at least one synthetically modified sugar-phosphate backbone. In some embodiments, the modified oligonucleotide comprises a nucleobase sequence including at least 12, at least 13, at least 14, at least 15, at least 16, at least 17, at least 18, at least 19, at least 20, at least 21, at least 22, at least 23, at least 24, or at least 25 contiguous nucleobases complementary to an equal length portion of SEQ ID NO: 725 (IRS1). In some embodiments, the modified oligonucleotide is a modified antisense strand. In some embodiments, the modified oligonucleotide is conjugated to a targeting ligand that targets a hepatocyte.

In some embodiments, the inhibitory agent is an oligomeric duplex. In some embodiments, the oligomeric duplex comprises a first modified oligonucleotide and a second modified oligonucleotide. In some embodiments, the first modified oligonucleotide consists of 10 to 50 linked nucleosides, 10 to 30 linked nucleosides, 12 to 30 linked nucleosides, 15 to 50 linked nucleosides, 20 to 50 linked nucleosides, or 12 to 50 linked nucleosides. In an exemplary embodiments, the first modified oligonucleotide consists of between 12 to 30 or 12 to 50 linked nucleosides. In some embodiments, the first modified oligonucleotide comprises a nucleobase sequence including at least 12, at least 13, at least 14, at least 15, at least 16, at least 17, at least 18, at least 19, at least 20, at least 21, at least 22, at least 23, at least 24, or at least 25 contiguous nucleobases complementary to an equal length portion of SEQ ID NO: 725 (IRS1). In some embodiments, the first modified oligonucleotide is a modified antisense strand. In some embodiments, the second modified oligonucleotide consists of 10 to 50 linked nucleosides, 10 to 30 linked nucleosides, 12 to 30 linked nucleosides, 15 to 50 linked nucleosides, 20 to 50 linked nucleosides, or 12 to 50 linked nucleosides. In an exemplary embodiments, the second modified oligonucleotide consists of between 12 to 30 or 12 to 50 linked nucleosides. In some embodiments, the second modified oligonucleotide comprises a complementary region of at least 8 nucleobases that is at least 90% complementary (e.g., at least 91%, 92%, 93%, 94%, 95%, 96%, 97%, 98%, 99%, or 100% complementary) to the nucleobase sequence of an equal length portion of the first modified oligonucleotide. In some embodiments, the second modified oligonucleotide is a modified sense strand. In some embodiments, the first and/or second modified oligonucleotide is conjugated to a targeting ligand that targets a hepatocyte.

In some embodiments, the inhibitory agent is an RNAi agent. In some embodiments, the RNAi agent comprises an antisense strand and a sense strand. In some embodiments, the antisense strand of the RNAi agent is 10 to 40, 10 to 30, 13 to 30, or 13 to 26 nucleotides in length. In some embodiments, the antisense strand of the RNAi agent is 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides in length. In some embodiments, the antisense strand of the RNAi agent is between 1 to 10 nucleotides, 5 to 15 nucleotides, 10 to 20 nucleotides, 15-25 nucleotides, 20-30 nucleotides, 25-35 nucleotides, or 30 to 40 nucleotides in length. In a specific embodiment, the antisense strand of the RNAi agent is between 20-25 nucleotides in length.

In some embodiments, the sense strand of the RNAi agent is 10 to 40, 10 to 30, 13 to 30, or 13 to 26 nucleotides in length. In some embodiments, the sense strand of the RNAi agent is 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides in length. In some embodiments, the sense strand of the RNAi agent is between 1 to 10 nucleotides, 5 to 15 nucleotides, 10 to 20 nucleotides, 15-25 nucleotides, 20-30 nucleotides, 25-35 nucleotides, or 30 to 40 nucleotides in length. In a specific embodiment, the antisense strand of the RNAi agent is between 20-25 nucleotides in length.

In some embodiments, the RNAi agent comprises an antisense strand with a 3' overhang of nucleotides. In some embodiments, the antisense strand 3' overhang is 1, 2, 3, 4, 5, 6, 7, 8, 9, or 10 nucleotides in length. In some embodiments, the antisense strand comprises a 3' overhang of 1-10 nucleotides in length, 1-9 nucleotides in length, 1-8 nucleotides in length, 1-7 nucleotides in length, 1-6 nucleotides in length, 1-5 nucleotides in length, 1-4 nucleotides in length, 1-3 nucleotides in length, 1 or 2 nucleotides in length, or 1 nucleotide in length. In a specific embodiment, the RNAi agent comprises an antisense strand comprising a 3' overhang of 1-5 nucleotides in length.

In some embodiments, the RNAi agent comprises an antisense strand with a 5' overhang of nucleotides. In some embodiments, the antisense strand 5' overhang is 1, 2, 3, 4, 5, 6, 7, 8, 9, or 10 nucleotides in length. In some embodiments, the antisense strand comprises a 5' overhang of 1-10 nucleotides in length, 1-9 nucleotides in length, 1-8 nucleotides in length, 1-7 nucleotides in length, 1-6 nucleotides in length, 1-5 nucleotides in length, 1-4 nucleotides in length, 1-3 nucleotides in length, 1 or 2 nucleotides in length, or 1 nucleotide in length. In a specific embodiment, the RNAi agent comprises an antisense strand comprising a 5' overhang of 1-5 nucleotides in length.

In some embodiments, the RNAi agent comprises a sense strand with a 3' overhang of nucleotides. In some embodiments, the sense strand 3' overhang is 1, 2, 3, 4, 5, 6, 7, 8, 9, or 10 nucleotides in length. In some embodiments, the sense strand comprises a 3' overhang of 1-10 nucleotides in length, 1-9 nucleotides in length, 1-8 nucleotides in length, 1-7 nucleotides in length, 1-6 nucleotides in length, 1-5 nucleotides in length, 1-4 nucleotides in length, 1-3 nucleotides in length, 1 or 2 nucleotides in length, or 1 nucleotide in length. In a specific embodiment, the RNAi agent comprises a sense strand comprising a 3' overhang of 1-5 nucleotides in length.

In some embodiments, the RNAi agent comprises a sense strand with a 5' overhang of nucleotides. In some embodiments, the sense strand 5' overhang is 1, 2, 3, 4, 5, 6, 7, 8, 9, or 10 nucleotides in length. In some embodiments, the sense strand comprises a 5' overhang of 1-10 nucleotides in length, 1-9 nucleotides in length, 1-8 nucleotides in length, 1-7 nucleotides in length, 1-6 nucleotides in length, 1-5 nucleotides in length, 1-4 nucleotides in length, 1-3 nucleotides in length, 1 or 2 nucleotides in length, or 1 nucleotide in length. In a specific embodiment, the RNAi agent comprises a sense strand comprising a 5' overhang of 1-5 nucleotides in length.

In some embodiments, 3' overhang of the sense and/or the antisense strand comprises uracil and/or comprises nucleotides complementary to a sequence in a pregenomic RNA and/or mRNA molecule that encodes insulin receptor substrate-1 (IRS1). In some embodiments, 5' overhang of the sense and/or the antisense strand comprises uracil and/or comprises nucleotides complementary to a sequence in a pregenomic RNA and/or mRNA molecule that encodes insulin receptor substrate-1 (IRS1).

In some embodiments, 3' overhang of the sense and/or the antisense strand comprises uracil and/or comprises nucleotides partially complementary to a sequence in a pregenomic RNA and/or mRNA molecule that encodes insulin receptor substrate-1 (IRS1). In some embodiments, 5' overhang of the sense and/or the antisense strand comprises uracil and/or comprises nucleotides partially complementary to a sequence in a pregenomic RNA and/or mRNA molecule that encodes insulin receptor substrate-1 (IRS1).

In some embodiments, the antisense strand of the RNAi agent comprises nucleobases that complement a sequence in an mRNA molecule that encodes insulin receptor substrate-1 (IRS1). In some embodiments, the mRNA molecule that encodes IRS1 comprises a nucleobase sequence according to SEQ ID NO: 725. In some embodiments, the antisense strand comprises at least 5, 6, 7, 8, 9, 10, 11, 12, 13, 14, 15, 16, 17, 18, 18, 20, 21, 22, 23, 24, 25, 26, 27, 28, 29, or 30 contiguous bases that complement a sequence in an IRS1 mRNA molecule. In some embodiments, the antisense strand comprises at least 14 contiguous bases that complement a sequence in an IRS1 mRNA molecule. In some embodiments, the antisense strand comprises at least 15 contiguous bases that complement a sequence in an IRS1 mRNA molecule. In some embodiments, the antisense strand comprises at least 16 contiguous bases that complement a sequence in an IRS1 mRNA molecule. In some embodiments, the antisense strand comprises at least 17 contiguous bases that complement a sequence in an IRS1 mRNA molecule.

In some embodiments, the antisense strand of the RNAi agent comprises a uracil nucleobase at the 5' terminus or the sense strand of the RNAi agent comprises an adenine nucleobase at the 3' terminus. In some embodiments, the antisense strand of the RNAi agent comprises a uracil nucleobase at the 5' terminus and the sense strand of the RNAi agent comprises an adenine nucleobase at the 3' terminus. The addition of an extra uracil nucleobase at the 5' terminus of the antisense strand and/or an extra adenine nucleobase at the 3' terminus of the sense strand can optimize performance of the RNAi agent by promoting the correct strand uptake by the RNA-induced silencing complex (RISC), enhancing duplex stability, protecting against degradation, and minimizing off-target effects. These modifications may help ensure that the designed siRNA is efficient and effective in gene silencing. The antisense strand sequences provided herein may comprise an extra uracil nucleobase at the 5' terminus, and/or the sense strand sequences provided herein may comprise an extra adenine nucleobase at the 3' terminus. In some embodiments, the antisense strand comprises, in order, nucleotides 2-23 of any one of SEQ ID NOS: 1-96, 385-457, 677-688, 193-288, 531-603, and 701-712. In some embodiments, the sense strand comprises, nucleotides 1-22 of any one of SEQ ID NOS: 97-192, 458-530, 689-700, 289-384, 604-676, 713-724, and 726-731.

In some embodiments, the antisense strand and the sense strand of the RNAi agent are self-complementary (i.e., each strand comprises a nucleotide sequence that is complementary to nucleotide sequence of the other strand) or at least partially complementary. In this instance, the antisense strand and sense strand will form a duplex (i.e., double stranded structure) that does not comprise overhangs. In some embodiments, the RNAi agent comprises a duplex structure. In some embodiments, the RNAi agent comprises a duplex length of at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides long. In some embodiments, the RNAi agent comprises a duplex of between 5 to 25 nucleotides long, 10 to 30 nucleotides long, 15 to 35 nucleotides long, 20 to 40 nucleotides long, 10 to 20 nucleotides long, 15 to 25 nucleotides long, 20 to 30 nucleotides long, 25 to 35 nucleotides long, 30 to 40 nucleotides long, 5 to 20 nucleotides long, 10 to 25 nucleotides long, 15 to 30 nucleotides long, 20 to 35 nucleotides long, or 25 to 40 nucleotides long. In an exemplary embodiment, the RNAi agent comprises a duplex of between 15 to 30 nucleotides long. In some embodiments, the RNAi agent comprises a duplex of 14 nucleotides in length, a duplex of 15 nucleotides in length, 16 nucleotides in length, 17 nucleotides in length, 18 nucleotides in length, 19 nucleotides in length, or 20 nucleotides in length. In a specific embodiment, the RNAi agent comprises a duplex of 16 nucleotides in length.

In some embodiments, the RNAi agent comprises a duplex region of any length that permits specific degradation of a desired target mRNA (i.e., IRS1) through RISC, and may range from about 9 to 36 nucleotides in length, e.g., about 10-30, 10-35, 14-30, 14-35, 15-30, 15-35, 24-30, or 19-23 nucleotides in length. In some embodiments, the RNAi agent comprises a duplex region of about 9, 10, 11, 12, 13, 14, 15, 16, 17, 18, 19, 20, 21, 22, 23, 24, 25, 26, 27, 28, 29, 30, 31, 32, 33, 34, 35, or 36 nucleotides in length, such as about 14-30, 14-35, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited example ranges and lengths are also contemplated to be part of the invention.

The sequences disclosed here may refer to a nucleobase sequence, a nucleotide sequence, or a modified nucleotide sequence, for example as described in Tables 1-3 and otherwise described herein.

TABLE 1

IRS1 RNAi agent antisense strand sequences.

| Antisense Sequence (5'→3') | SEQ ID NO: | Modified Antisense Sequence (5'→3') | SEQ ID NO: |
|---|---|---|---|
| UGACGGAGCCUCCGCGCUCGGCA | 1 | usGfsacgGfagccuccGfcGfcucggscsa | 193 |
| UACGUGACGGAGCCUCCGCGCUC | 2 | usAfscguGfacggagcCfuCfcgcgcsusc | 194 |
| UGAAAAACACGUGACGGAGCCUC | 3 | usGfsaaaAfacacgugAfcGfgagccsusc | 195 |
| UCGUCUGGCUCUGCGCGCCGGCC | 4 | usCfsgucUfggcucugCfgCfgccggscsc | 196 |
| UAACAAGCGGCGGCGUCUGGCUC | 5 | usAfsacaAfgcggcggCfgUfcuggcsusc | 197 |
| UAAACAAGCGGCGGCGUCUGGCU | 6 | usAfsaacAfagcggcgGfcGfucuggscsu | 198 |
| UAAAACAAGCGGCGGCGUCUGGC | 7 | usAfsaaaCfaagcggcGfgCfgucugsgsc | 199 |
| UCAACCAAAACAAGCGGCGGCGU | 8 | usCfsaacCfaaaacaaGfcGfgcggcsgsu | 200 |
| UCCAACCAAAACAAGCGGCGGCG | 9 | usCfscaaCfcaaaacaAfgCfggoggscsg | 201 |
| UUCGGAGAGUUGCCGAGAGCCCC | 10 | usUfscggAfgaguugcCfgAfgagccscsc | 202 |
| UCAACGUUGCACGGGGUUCUCCC | 11 | usCfsaacGfuugcacgGfgGfuucucscsc | 203 |
| UCCCAACGUUGCACGGGGUUCUC | 12 | usCfsccaAfcguugcaCfgGfgguucsusc | 204 |
| UUCCCAACGUUGCACGGGGUUCU | 13 | usUfscccAfacguugcAfcGfggguuscsu | 205 |
| UUUCCCGAGGCAAAUUAAAUAUC | 14 | usUfsuccCfgaggcaaAfuUfaaauasusc | 206 |
| UCGAAGAUGCAUCUCUCGUCGCC | 15 | usCfsgaaGfaugcaucUfcUfcgucgscsc | 207 |
| UGAGCGAAGAUGCAUCUCUCGUC | 16 | usGfsagcGfaagaugcAfuCfucucgsusc | 208 |
| UAUCCUCCGAGAGCCAAGUCUCC | 17 | usAfsuccUfccgagagCfcAfagucuscsc | 209 |
| UGUUUUCGGGCGCUUCACGCCCG | 18 | usGfsuuuUfcgggcgcUfuCfacgccscsg | 210 |
| UAGUUUUCGGGCGCUUCACGCCC | 19 | usAfsguuUfucgggcgCfuUfcacgcscsc | 211 |
| UGAGUUUUCGGGCGCUUCACGCC | 20 | usGfsaguUfuucgggcGfcUfucacgscsc | 212 |
| UACCGGAGUUUUCGGGCGCUUCA | 21 | usAfsccgGfaguuuucGfgGfcgcuuscsa | 213 |
| UCCGACCGGAGUUUUCGGGCGCU | 22 | usCfscgaCfcggaguuUfuCfgggcgscsu | 214 |
| UCCCGACCGGAGUUUUCGGGCGC | 23 | usCfsccgAfccggaguUfuUfcgggcsgsc | 215 |
| UGCCCGACCGGAGUUUUCGGGCG | 24 | usGfscccGfaccggagUfuUfucgggscsg | 216 |
| UUCCGAGAAGCCAUCGCUCUCCG | 25 | usUfsccgAfgaagccaUfcGfcucucscsg | 217 |
| UCGUCCGAGAAGCCAUCGCUCUC | 26 | usCfsgucCfgagaagcCfaUfcgcucsusc | 218 |

TABLE 1-continued

| IRS1 RNAi agent antisense strand sequences. | | | |
|---|---|---|---|
| Antisense Sequence (5'→3') | SEQ ID NO: | Modified Antisense Sequence (5'→3') | SEQ ID NO: |
| UAGCCCACCUUGCGCACGUCCGA | 27 | usAfsgccCfaccuugcGfcAfcguccsgsa | 219 |
| UUAGCCCACCUUGCGCACGUCCG | 28 | usUfsagcCfcaccuugCfgCfacgucscsg | 220 |
| UUUGGGUUUGCGCAGGUAGCCCA | 29 | usUfsuggGfuuugcgcAfgGfuagccscsa | 221 |
| UAAGAAGCGUUUGUGCAUGCUCU | 30 | usAfsagaAfgcguuugUfgCfaugcuscsu | 222 |
| UUACGAAGAAGCGUUUGUGCAUG | 31 | usUfsacgAfagaagcgUfuUfgugcasusg | 223 |
| UAGUACGAAGAAGCGUUUGUGCA | 32 | usAfsguaCfgaagaagCfgUfuugugscsa | 224 |
| UUAGUACUCGAGGCGCGCCGGGC | 33 | usUfsaguAfcucgaggCfgCfgccggsgsc | 225 |
| UACUUGUGCCGCCACUUCUUCUC | 34 | usAfscuuGfugccgccAfcUfucuucsusc | 226 |
| UGACUUGUGCCGCCACUUCUUCU | 35 | usGfsacuUfgugccgcCfaCfuucuuscsu | 227 |
| UGCUCGACUUGUGCCGCCACUUC | 36 | usGfscucGfacuugugCfcGfccacususc | 228 |
| UGUCAGCCCGCUUGUUGAUGUUG | 37 | usGfsucaGfcccgcuuGfuUfgaugusug | 229 |
| UAGUCAGCCCGCUUGUUGAUGUU | 38 | usAfsgucAfgcccgcuUfgUfugaugsusu | 230 |
| UUCUUGGAGUCAGCCCGCUUGUU | 39 | usUfscuuGfgagucagCfcCfgcuugsusu | 231 |
| UACGGUUGUGCAGCUGUAGGAGA | 40 | usAfscggUfugugcagCfuGfuaggasgsa | 232 |
| UGCGGUAGAUACCAAUCAGGUUC | 41 | usGfscggUfagauaccAfaUfcaggususc | 233 |
| UCAGCGCCUGAUGUUCAUCAGCU | 42 | usCfsagcGfccugaugUfuCfaucagcsu | 234 |
| UGCAGUUGGACGAGGACUGGCUC | 43 | usGfscagUfuggacgaGfgAfcuggcsusc | 235 |
| UUGGUGCCUUCGCCGUCACUGGA | 44 | usUfsgguGfccuucgcCfgUfcacugsgsa | 236 |
| UCAUGGUGCCUUCGCCGUCACUG | 45 | usCfsaugGfugccuucGfcCfgucacsusg | 237 |
| UGACAUGGUGCCUUCGCCGUCAC | 46 | usGfsacaUfggugccuUfcGfccgucsasc | 238 |
| UUCCGAGGUGGAGCCAUGGCCAC | 47 | usUfsccgAfgguggagCfcAfuggccsasc | 239 |
| UAAGAGACAAUCCGAGGUGGAGC | 48 | usAfsagaGfacaauccGfaGfguggasgsc | 240 |
| UCUAGAUCGCCGUGGGAAGAGAC | 49 | usCfsuagAfucgccguGfgGfaagagsasc | 241 |
| UGAAGCACUAGAUCGCCGUGGGA | 50 | usGfsaagCfacuagauCfgCfcguggsgsa | 242 |
| UCACCGAAGCACUAGAUCGCCGU | 51 | usCfsaccGfaagcacuAfgAfucgccsgsu | 243 |
| UACACCGAAGCACUAGAUCGCCG | 52 | usAfscacCfgaagcacUfaGfaucgcscsg | 244 |
| UGACACCGAAGCACUAGAUCGCC | 53 | usGfsacaCfcgaagcaCfuAfgaucgscsc | 245 |
| UAAAUCGCAGGGACUGGAGCCAU | 54 | usAfsaauCfgcagggaCfuGfgagccsasu | 246 |
| UCGGAAAUCGCAGGGACUGGAGC | 55 | usCfsggaAfaucgcagGfgAfcuggasgsc | 247 |
| UGCAGAUAUAGUUGCUUAGCUCC | 56 | usGfscagAfuauaguuGfcUfuagcuscsc | 248 |
| UCCGAGACAAAAUGUAGUGACCG | 57 | usCfscgaGfacaaaauGfuAfgugacscsg | 249 |
| UAAGGCUGGACUCGUGCCCAAGC | 58 | usAfsaggCfuggacucGfuGfcccaasgsc | 250 |
| UUGAGUUCUCUUUCGGAACCGAU | 59 | usUfsgagUfucucuuuCfgGfaaccgsasu | 251 |
| UUACUCCUCAAUGGAAGCCACUG | 60 | usUfsacuCfcucaaugGfaAfgccacsusg | 252 |
| UCGUCUGAUGGGAUUGAUGAUCU | 61 | usCfsgucUfgaugggaUfuGfaugauscsu | 253 |
| UGGACAUCAUCAUGUAGCCAUUG | 62 | usGfsgacAfucaucauGfuAfgccausug | 254 |
| UCUUGGCAAUGAGUAGUAGGAGA | 63 | usCfsuugGfcaaugagUfaGfuaggasgsa | 255 |

TABLE 1-continued

| IRS1 RNAi agent antisense strand sequences. | | | |
|---|---|---|---|
| Antisense Sequence (5'→3') | SEQ ID NO: | Modified Antisense Sequence (5'→3') | SEQ ID NO: |
| UCGCUGGGUGUGCUUAAAGGAUC | 64 | usCfsgcuGfggugugcUfuAfaaggasusc | 256 |
| UAGCAUAGAGAAGGCGACCAGAG | 65 | usAfsgcaUfagagaagGfcGfaccagsasg | 257 |
| UCUGUGUCCACCUUUCGAGGCAG | 66 | usCfsuguGfuccaccuUfuCfgaggcsasg | 258 |
| UUAUUGGUCUGAGCAGCUGUGUC | 67 | usUfsauuGfgucugagCfaGfcugugsusc | 259 |
| UGGCUAUUGGUCUGAGCAGCUGU | 68 | usGfsgcuAfuuggucuGfaGfcagcusgsu | 260 |
| UCCGAGGUAAGGUGCUGGCCUUG | 69 | usCfscgaGfguaagguGfcUfggccusgsg | 261 |
| UUGAGGUUCACCCGGGUGAAGGC | 70 | usUfsgagGfuucacccGfgGfugaagsgsc | 262 |
| UUUGCGGUUAGGACUGAGGUUCA | 71 | usUfsugcGfguuaggaCfuGfagguuscsa | 263 |
| UGUUGCGGUUAGGACUGAGGUUC | 72 | usGfsuugCfgguuaggAfcUfgaggusgsc | 264 |
| UUGGUUGCGGUUAGGACUGAGGU | 73 | usUfsgguUfgcgguuaGfgAfcugagsgsu | 265 |
| UCCGGCACCCUUGUGGGUCUGCA | 74 | usCfscggCfacccuugUfgGfgucugscsa | 266 |
| UUCUAUGUAGUUAAGACCAUUCU | 75 | usUfscuaUfguaguuaAfgAfccauuscsu | 267 |
| UGGCGCUUAAAUCCUCACUUGAG | 76 | usGfsgcgCfuuaaaucCfuCfacuugsasg | 268 |
| UACUGAUGCUGGCAUAGGCGCUU | 77 | usAfscugAfugcuggcAfuAfggcgcsusu | 269 |
| UAACGCUGUGAGAGGUUGGUGUC | 78 | usAfsacgCfugugagaGfgUfuggugsusc | 270 |
| UGUUGAUCAUUAAUGGAUUCUCU | 79 | usGfsuugAfucauuaaUfgGfauucuscsu | 271 |
| UGACUCAGGUGGUUGAUCAUUAA | 80 | usGfsacuCfaggugguUfgAfucauusasa | 272 |
| UUAUUGACUCAGGUGGUUGAUCA | 81 | usUfsauuGfacucaggUfgGfuugauscsa | 273 |
| UACCUCCAACUAACAUUCAUCAU | 82 | usAfsccuCfcaacuaaCfaUfucaucsasu | 274 |
| UGCAUUACCUCCAACUAACAUUC | 83 | usGfscauUfaccuccaAfcUfaacausus c | 275 |
| UUUAGUCUUGGCAAGGUCAUAUU | 84 | usUfsuagUfcuuggcaAfgGfucauasusu | 276 |
| UUUUAUCCUCGGUGUUCUACUCA | 85 | usUfsuuaUfccucgguGfuUfcuacuscsa | 277 |
| UGGUUAAGCACCUCCAAUAUCAU | 86 | usGfsguuAfagcaccuCfcAfauaucsasu | 278 |
| UGGGUUAAGCACCUCCAAUAUCA | 87 | usGfsgguUfaagcaccUfcCfaauauscsa | 279 |
| UCUAUCCUAUGGCAUACUCGUUA | 88 | usCfsuauCfcuauggcAfuAfcucgususa | 280 |
| UAUUUGUCCUAUCCUAUGGCAUA | 89 | usAfsuuuGfuccuaucCfuAfuggcasusa | 281 |
| UGAACUACAUUCUUAAGCCAAUG | 90 | usGfsaacUfacauucuUfaAfgccaasusg | 282 |
| UGGAACUACAUUCUUAAGCCAAU | 91 | usGfsgaaCfuacauucUfuAfagccasasu | 283 |
| UUUUGGCCCACCCUGUAGCCAAG | 92 | usUfsuugGfcccacccUfgUfagccasasg | 284 |
| UGUUUAAUUUGGCCCACCCUGUA | 93 | usGfsuuuAfauuuggcCfcAfcccugsusa | 285 |
| UUGGUAGCAAUACAGACCAUGCA | 94 | usUfsgguAfgcaauacAfgAfccaugscsa | 286 |
| UGCAUAACACUAUAAAGAAAACU | 95 | usGfscauAfacacuauAfaAfgaaaascsu | 287 |
| UGACAUUAAGGACCACUAAUAUU | 96 | usGfsacaUfuaaggacCfaCfuaauasusu | 288 |
| CCGGAGGGCUCGCCAUGCUGCCA | 385 | csCfsggaGfggcucgcCfaUfgcugcscsa | 531 |
| GGUAGCCCACCUUGCGCACGUCC | 386 | gsGfsuagCfccaccuuGfcGfcacguscsc | 532 |
| AGGUAGCCCACCUUGCGCACGUC | 387 | asGfsguaGfcccaccuUfgCfgcacgsusc | 533 |
| AAGCGUUUGUGCAUGCUCUUGGG | 388 | asAfsgcgUfuugugcaUfgCfucuugsgsg | 534 |

TABLE 1-continued

IRS1 RNAi agent antisense strand sequences.

| Antisense Sequence (5'→3') | SEQ ID NO: | Modified Antisense Sequence (5'→3') | SEQ ID NO: |
|---|---|---|---|
| GAAGCGUUUGUGCAUGCUCUUGG | 389 | gsAfsagcGfuuugugcAfuGfcucuusgsg | 535 |
| ACGAAGAAGCGUUUGUGCAUGCU | 390 | asCfsgaaGfaagcguuUfgUfgcaugscsu | 536 |
| AGUACGAAGAAGCGUUUGUGCAU | 391 | asGfsuacGfaagaagcGfuUfugugcsasu | 537 |
| UGUGCCGCCACUUCUUCUCGUUC | 392 | usGfsugcCfgccacuuCfuUfcucgususc | 538 |
| CUUGUGCCGCCACUUCUUCUCGU | 393 | csUfsuguGfccgccacUfuCfuucucsgsu | 539 |
| UCGACUUGUGCCGCCACUUCUUC | 394 | usCfsgacUfugugccgCfcAfcuucususc | 540 |
| CUCGACUUGUGCCGCCACUUCUU | 395 | csUfscgaCfuugugccGfcCfacuucsusu | 541 |
| GCUCGACUUGUGCCGCCACUUCU | 396 | gsCfsucgAfcuugugcCfgCfcacuuscsu | 542 |
| GCUUGUUCUUGGAGUCAGCCCGC | 397 | gsCfsuugUfucuuggaGfuCfagcccsgsc | 543 |
| UGCUUGUUCUUGGAGUCAGCCCG | 398 | usGfscuuGfuucuuggAfgUfcagccscsg | 544 |
| GUGCUUGUUCUUGGAGUCAGCCC | 399 | gsUfsgcuUfguucuugGfaGfucagcscsc | 545 |
| GCCACCAGGUGCUUGUUCUUGGA | 400 | gsCfscacCfaggugcuUfgUfucuugsgsa | 546 |
| GGGUGUAGAGAGCCACCAGGUGC | 401 | gsGfsgugUfagagagcCfaCfcaggusgsc | 547 |
| CCCGGGUGUAGAGAGCCACCAGG | 402 | csCfscggGfuguagagAfgCfcaccasgsg | 548 |
| GGUACCAGCUGUCUUGCUCGGCC | 403 | gsGfsuacCfagcugucUfuGfcucggscsc | 549 |
| ACGUCACCGUAGCUCAAGUCCUC | 404 | asCfsgucAfccguagcUfcAfaguccsusc | 550 |
| UGUCUGACCCAGGCCCUUGGGCU | 405 | usGfsucuGfacccaggCfcCfuugggscsu | 551 |
| CAGGUUCUUUGUCUGACCCAGGC | 406 | csAfsgguUfcuuugucUfgAfcccagsgsc | 552 |
| UCAGGUUCUUUGUCUGACCCAGG | 407 | usCfsaggUfucuuuguCfuGfacccasgsg | 553 |
| GCGGUAGAUACCAAUCAGGUUCU | 408 | gsCfsgguAfgauaccaAfuCfagguuscsu | 554 |
| AGGCGGUAGAUACCAAUCAGGUU | 409 | asGfsgcgGfuagauacCfaAfucaggsusu | 555 |
| AAGCUGAUGGUCUUGCUGGUCAG | 410 | asAfsgcuGfauggucuUfgCfuggucsasg | 556 |
| CAGAACGGCCCACCUCGAUGAAG | 411 | csAfsgaaCfggcccacCfuCfgaugasasg | 557 |
| CUUGCUGCGAGGGCGGAACUCAU | 412 | csUfsugcUfgcgagggCfgGfaacucsasu | 558 |
| GGGACAUGGUGCCUUCGCCGUCA | 413 | gsGfsgacAfuggugccUfuCfgccguscsa | 559 |
| UGGAGCGGCUGUGGUUGAGCGGG | 414 | usGfsgagCfggcugugGfuUfgagcgsgsg | 560 |
| AAGAGACAAUCCGAGGUGGAGCC | 415 | asAfsgagAfcaauccgAfgGfuggagscsc | 561 |
| AGAUCGCCGUGGGAAGAGACAAU | 416 | asGfsaucGfccgugggAfaGfagacasasu | 562 |
| AGCACUAGAUCGCCGUGGGAAGA | 417 | asGfscacUfagaucgcCfgUfgggaasgsa | 563 |
| GAGAUGAAACCGCCAUCGCUGGG | 418 | gsAfsgauGfaaaccgcCfaUfcgcugsgsg | 564 |
| UCCGGAAAUCGCAGGGACUGGAG | 419 | usCfscggAfaaucgcaGfgGfacuggsasg | 565 |
| ACUCCGGAAAUCGCAGGGACUGG | 420 | asCfsuccGfgaaaucgCfaGfggacusgsg | 566 |
| AACUCCGGAAAUCGCAGGGACUG | 421 | asAfscucCfggaaaucGfcAfgggacsusg | 567 |
| AGGAACUCCGGAAAUCGCAGGGA | 422 | asGfsgaaCfuccggaaAfuCfgcaggsgsa | 568 |
| GUGACACUGCGGAAGGAACUCCG | 423 | gsUfsgacAfcugcggaAfgGfaacucscsg | 569 |
| AUCCGGAGUGACACUGCGGAAGG | 424 | asUfsccgGfagugacaCfuGfcggaasgsg | 570 |
| GGAAUCCGGAGUGACACUGCGGA | 425 | gsGfsaauCfcggagugAfcAfcugcgsgsa | 571 |

TABLE 1-continued

IRS1 RNAi agent antisense strand sequences.

| Antisense Sequence (5'→3') | SEQ ID NO: | Modified Antisense Sequence (5'→3') | SEQ ID NO: |
|---|---|---|---|
| CACCUCCUGGUGGGUAGGCAGGC | 426 | csAfsccuCfcugguggGfuAfggcagsgsc | 572 |
| GGGCAUAUAGUCUCCACUGCCCU | 427 | gsGfsgcaUfauagucuCfcAfcugccscsu | 573 |
| UCAUGGGCAUAUAGUCUCCACUG | 428 | usCfsaugGfgcauauaGfuCfuccacsusg | 574 |
| GGCGUCUGAUGGGAUUGAUGAUC | 429 | gsGfscguCfugaugggAfuUfgaugasusc | 575 |
| UGGCGUCUGAUGGGAUUGAUGAU | 430 | usGfsgcgUfcugauggGfaUfugaugsasu | 576 |
| UGUAGUCACCUGUGCAAGGUAAG | 431 | usGfsuagUfcaccuguGfcAfagguasasg | 577 |
| UCAUGUAGUCACCUGUGCAAGGU | 432 | usCfsaugUfagucaccUfgUfgcaagsgsu | 578 |
| GUUCAUGUAGUCACCUGUGCAAG | 433 | gsUfsucaUfguagucaCfcUfgugcasasg | 579 |
| AUGUUCAUGUAGUCACCUGUGCA | 434 | asUfsguuCfauguaguCfaCfcugugscsa | 580 |
| GGCGCUGGGUGUGCUUAAAGGAU | 435 | gsGfscgcUfgggugugCfuUfaaaggsasu | 581 |
| GGGCGCUGGGUGUGCUUAAAGGA | 436 | gsGfsgcgCfuggguguGfcUfuaaagsgsa | 582 |
| AUAGAGAAGGCGACCAGAGCUAG | 437 | asUfsagaGfaaggcgaCfcAfgagcusasg | 583 |
| CGGCUAUUGGUCUGAGCAGCUGU | 438 | csGfsgcuAfuuggucuGfaGfcagcusgsu | 584 |
| GCGGCUAUUGGUCUGAGCAGCUG | 439 | gsCfsggcUfauuggucUfgAfgcagcsusg | 585 |
| UCACUUUGGCACUCUGGUUGCGG | 440 | usCfsacuUfuggcacuCfuGfguugcsgsg | 586 |
| CUGCACGGAUCACUUUGGCACUC | 441 | csUfsgcaCfggaucacUfuUfggcacsusc | 587 |
| GUGGGUCUGCACGGAUCACUUUG | 442 | gsUfsgggUfcugcacgGfaUfcacuususg | 588 |
| UCUAUGUAGUUAAGACCAUUCUC | 443 | usCfsuauGfuaguuaaGfaCfcauucsusc | 589 |
| AUCCUCACUUGAGCGGCGGGUGG | 444 | asUfsccuCfacuugagCfgGfcgggusgsg | 590 |
| AAUCCUCACUUGAGCGGCGGGUG | 445 | asAfsuccUfcacuugaGfcGfgcgggsusg | 591 |
| GCAUAGGCGCUUAAAUCCUCACU | 446 | gsCfsauaGfgcgcuuaAfaUfccucascsu | 592 |
| UGGCAUAGGCGCUUAAAUCCUCA | 447 | usGfsgcaUfaggcgcuUfaAfauccuscsa | 593 |
| AGGUCAUUUAGGUCUUCAUUCUG | 448 | asGfsgucAfuuuagguCfuUfcauucsusg | 594 |
| CUGAGGUCAUUUAGGUCUUCAUU | 449 | csUfsgagGfucauuuaGfgUfcuucasusu | 595 |
| GGAUUUGCUGAGGUCAUUUAGGU | 450 | gsGfsauuUfgcugaggUfcAfuuuagsgsu | 596 |
| UCCUAGUUGUGAAUCAUGAAAUA | 451 | usCfscuaGfuugugaaUfcAfugaaasusa | 597 |
| AUAUGAGGUCCUAGUUGUGAAUC | 452 | asUfsaugAfgguccuaGfuUfgugaasusc | 598 |
| CGUACCAUCUACUGAUGAGGAAG | 453 | csGfsuacCfaucuacuGfaUfgaggasasg | 599 |
| AUCGUACCAUCUACUGAUGAGGA | 454 | asUfscguAfccaucuaCfuGfaugagsgsa | 600 |
| GCAUCGUACCAUCUACUGAUGAG | 455 | gsCfsaucGfuaccaucUfaCfugaugsasg | 601 |
| UGCAUCGUACCAUCUACUGAUGA | 456 | usGfscauCfguaccauCfuAfcugausgsa | 602 |
| AUGCAUCGUACCAUCUACUGAUG | 457 | asUfsgcaUfcguaccaUfcUfacugasusg | 603 |
| GAACGUGCAGUUCAGUCAAUGAA | 677 | gsAfsacgUfgcaguucAfgUfcaaugsasa | 701 |
| AGAACGUGCAGUUCAGUCAAUGA | 678 | asGfsaacGfugcaguuCfaGfucaausgsa | 702 |
| UAGAACGUGCAGUUCAGUCAAUG | 679 | usAfsgaaCfgugcaguUfcAfgucaasusg | 703 |
| GCACAAUAUAGAACGUGCAGUUC | 680 | gsCfsacaAfuauagaaCfgUfgcagususc | 704 |
| UCUCAUGACACGGUGGUGGGCAC | 681 | usCfsucaUfgacacggUfgGfugggcsasc | 705 |

TABLE 1-continued

IRS1 RNAi agent antisense strand sequences.

| Antisense Sequence (5'→3') | SEQ ID NO: | Modified Antisense Sequence (5'→3') | SEQ ID NO: |
|---|---|---|---|
| CUCUCAUGACACGGUGGUGGGCA | 682 | csUfscucAfugacacgGfuGfgugggscsa | 706 |
| AGGAUCAUACCCUAUUCUACUCU | 683 | asGfsgauCfauacccuAfuUfcuacuscsu | 707 |
| AUGGCACUAUGAUUCUUAUAUUA | 684 | asUfsggcAfcuaugauUfcUfuauaususa | 708 |
| UCUAUGGCACUAUGAUUCUUAUA | 685 | usCfsuauGfgcacuauGfaUfucuuasusa | 709 |
| AGAGAUAGUAUCAGCAAAUAUAA | 686 | asGfsagaUfaguaucaGfcAfaauausasa | 710 |
| CAAGAGAUAGUAUCAGCAAAUAU | 687 | csAfsagaGfauaguauCfaGfcaaausasu | 711 |
| AGAUCAACAGUAUCUAGUUUAUU | 688 | asGfsaucAfacaguauCfuAfguuuasusu | 712 |

TABLE 2

IRS1 RNAi agent sense strand sequences.

| Sense Sequence (5'→3') | SEQ ID NO: | Modified Sense Sequence (5'→3') | SEQ ID NO: |
|---|---|---|---|
| CCGAGCGCGGAGGCUCCGUCA | 97 | cscsgagcGfcGfGfAfggcuccguscsa | 289 |
| GCGCGGAGGCUCCGUCACGUA | 98 | gscsgcggAfgGfCfUfccgucacgsusa | 290 |
| GGCUCCGUCACGUGUUUUUCA | 99 | gsgscuccGfuCfAfCfguguuuuuscsa | 291 |
| CCGGCGCGCAGAGCCAGACGA | 100 | cscsggcgCfgCfAfGfagccagacsgsa | 292 |
| GCCAGACGCCGCCGCUUGUUA | 101 | gscscagaCfgCfCfGfccgcuugususa | 293 |
| CCAGACGCCGCCGCUUGUUUA | 102 | cscsagacGfcCfGfCfcgcuuguususa | 294 |
| CAGACGCCGCCGCUUGUUUUA | 103 | csasgacgCfcGfCfCfgcuuguuususa | 295 |
| GCCGCCGCUUGUUUUGGUUGA | 104 | gscscgccGfcUfUfGfuuuugguusgsa | 296 |
| CCGCCGCUUGUUUUGGUUGGA | 105 | cscsgccgCfuUfGfUfuuugguugsgsa | 297 |
| GGCUCUCGGCAACUCUCCGAA | 106 | gsgscucuCfgGfCfAfacucuccgsasa | 298 |
| GAGAACCCCGUGCAACGUUGA | 107 | gsasgaacCfcCfGfUfgcaacguusgsa | 299 |
| GAACCCCGUGCAACGUUGGGA | 108 | gsasacccCfgUfGfCfaacguuggsgsa | 300 |
| AACCCCGUGCAACGUUGGGAA | 109 | asascccCfGfuGfCfAfacguugggsasa | 301 |
| UAUUUAAUUUGCCUCGGGAAA | 110 | usasuuuaAfuUfUfGfccucgggasasa | 302 |
| CGACGAGAGAUGCAUCUUCGA | 111 | csgsacgaGfaGfAfUfgcaucuucsgsa | 303 |
| CGAGAGAUGCAUCUUCGCUCA | 112 | csgsagagAfuGfCfAfucuucgcuscsa | 304 |
| AGACUUGGCUCUCGGAGGAUA | 113 | asgsacuuGfgCfUfCfucggaggasusa | 305 |
| GGCGUGAAGCGCCCGAAAACA | 114 | gsgscgugAfaGfCfGfcccgaaaascsa | 306 |
| GCGUGAAGCGCCCGAAAACUA | 115 | gscsgugaAfgCfGfCfccgaaaacsusa | 307 |
| CGUGAAGCGCCCGAAAACUCA | 116 | csgsugaaGfcGfCfCfcgaaaacuscsa | 308 |
| AAGCGCCCGAAAACUCCGGUA | 117 | asasgcgcCfcGfAfAfaacuccggsusa | 309 |
| CGCCCGAAAACUCCGGUCGGA | 118 | csgscccgAfaAfAfCfuccggucgsgsa | 310 |
| GCCCGAAAACUCCGGUCGGGA | 119 | gscsccgaAfaAfCfUfccggucggsgsa | 311 |
| CCCGAAAACUCCGGUCGGGCA | 120 | cscscgaaAfaCfUfCfcggucgggscsa | 312 |

TABLE 2-continued

IRS1 RNAi agent sense strand sequences.

| Sense Sequence (5'→3') | SEQ ID NO: | Modified Sense Sequence (5'→3') | SEQ ID NO: |
|---|---|---|---|
| GAGAGCGAUGGCUUCUCGGAA | 121 | gsasgagcGfaUfGfGfcuucucggsasa | 313 |
| GAGCGAUGGCUUCUCGGACGA | 122 | gsasgcgaUfgGfCfUfucucggacsgsa | 314 |
| GGACGUGCGCAAGGUGGGCUA | 123 | gsgsacguGfcGfCfAfaggugggcsusa | 315 |
| GACGUGCGCAAGGUGGGCUAA | 124 | gsascgugCfgCfAfAfggugggcusasa | 316 |
| GGCUACCUGCGCAAACCCAAA | 125 | gsgscuacCfuGfCfGfcaaacccasasa | 317 |
| AGCAUGCACAAACGCUUCUUA | 126 | asgscaugCfaCfAfAfacgcuucususa | 318 |
| UGCACAAACGCUUCUUCGUAA | 127 | usgscacaAfaCfGfCfuucuucgusasa | 319 |
| CACAAACGCUUCUUCGUACUA | 128 | csascaaaCfgCfUfUfcuucguacsusa | 320 |
| CCGGCGCGCCUCGAGUACUAA | 129 | cscsggcgCfgCfCfUfcgaguacusasa | 321 |
| GAAGAAGUGGCGGCACAAGUA | 130 | gsasagaaGfuGfGfCfggcacaagsusa | 322 |
| AAGAAGUGGCGGCACAAGUCA | 131 | asasgaagUfgGfCfGfgcacaaguscsa | 323 |
| AGUGGCGGCACAAGUCGAGCA | 132 | asgsuggcGfgCfAfCfaagucgagscsa | 324 |
| ACAUCAACAAGCGGGCUGACA | 133 | ascsaucaAfcAfAfGfcgggcugascsa | 325 |
| CAUCAACAAGCGGGCUGACUA | 134 | csasucaaCfaAfGfCfgggcugacsusa | 326 |
| CAAGCGGGCUGACUCCAAGAA | 135 | csasagcgGfgCfUfGfacuccaagsasa | 327 |
| UCCUACAGCUGCACAACCGUA | 136 | uscscuac AfgCfUfGfcacaaccgsusa | 328 |
| ACCUGAUUGGUAUCUACCGCA | 137 | ascscugaUfuGfGfUfaucuaccgscsa | 329 |
| CUGAUGAACAUCAGGCGCUGA | 138 | csusgaugAfaCfAfUfcaggcgcusgsa | 330 |
| GCCAGUCCUCGUCCAACUGCA | 139 | gscscaguCfcUfCfGfuccaacugscsa | 331 |
| CAGUGACGGCGAAGGCACCAA | 140 | csasgugaCfgGfCfGfaaggcaccsasa | 332 |
| GUGACGGCGAAGGCACCAUGA | 141 | gsusgacgGfcGfAfAfggcaccausgsa | 333 |
| GACGGCGAAGGCACCAUGUCA | 142 | gsascggcGfaAfGfGfcaccauguscsa | 334 |
| GGCCAUGGCUCCACCUCGGAA | 143 | gsgsccauGfgCfUfCfcaccucggsasa | 335 |
| UCCACCUCGGAUUGUCUCUUA | 144 | uscscaccUfcGfGfAfuugucucususa | 336 |
| CUCUUCCCACGGCGAUCUAGA | 145 | csuscuucCfcAfCfGfgcgaucuasgsa | 337 |
| CCACGGCGAUCUAGUGCUUCA | 146 | cscsacggCfgAfUfCfuagugcuuscsa | 338 |
| GGCGAUCUAGUGCUUCGGUGA | 147 | gsgscgauCfuAfGfUfgcuucggusgsa | 339 |
| GCGAUCUAGUGCUUCGGUGUA | 148 | gscsgaucUfaGfUfGfcuucggugsusa | 340 |
| CGAUCUAGUGCUUCGGUGUCA | 149 | csgsaucuAfgUfGfCfuucgguguscsa | 341 |
| GGCUCCAGUCCCUGCGAUUUA | 150 | gsgscuccAfgUfCfCfcugcgauususa | 342 |
| UCCAGUCCCUGCGAUUUCCGA | 151 | uscscaguCfcCfUfGfcgauuuccsgsa | 343 |
| AGCUAAGCAACUAUAUCUGCA | 152 | asgscuaaGfcAfAfCfuauaucugscsa | 344 |
| GUCACUACAUUUUGUCUCGGA | 153 | gsuscacuAfcAfUfUfuugucucgsgsa | 345 |
| UUGGGCACGAGUCCAGCCUUA | 154 | usgsgggcAfcGfAfGfuccagccususa | 346 |
| CGGUUCCGAAAGAGAACUCAA | 155 | csgsguucCfgAfAfAfgagaacucsasa | 347 |
| GUGGCUUCCAUUGAGGAGUAA | 156 | gsusggcuUfcCfAfUfugaggagusasa | 348 |
| AUCAUCAAUCCCAUCAGACGA | 157 | asuscaucAfaUfCfCfcaucagacsgsa | 349 |

TABLE 2-continued

IRS1 RNAi agent sense strand sequences.

| Sense Sequence (5'→3') | SEQ ID NO: | Modified Sense Sequence (5'→3') | SEQ ID NO: |
|---|---|---|---|
| AUGGCUACAUGAUGAUGUCCA | 158 | asusggcuAfcAfUfGfaugaugucscsa | 350 |
| UCCUACUACUCAUUGCCAAGA | 159 | uscscuacUfaCfUfCfauugccaasgsa | 351 |
| UCCUUUAAGCACACCCAGCGA | 160 | uscscuuuAfaGfCfAfcacccagcsgsa | 352 |
| CUGGUCGCCUUCUCUAUGCUA | 161 | csusggucGfcCfUfUfcucuaugcsusa | 353 |
| GCCUCGAAAGGUGGACACAGA | 162 | gscscucgAfaAfGfGfuggacacasgsa | 354 |
| CACAGCUGCUCAGACCAAUAA | 163 | csascagcUfgCfUfCfagaccaausasa | 355 |
| AGCUGCUCAGACCAAUAGCCA | 164 | asgscugcUfcAfGfAfccaauagcscsa | 356 |
| AGGCCAGCACCUUACCUCGGA | 165 | asgsgccaGfcAfCfCfuuaccucgsgsa | 357 |
| CUUCACCCGGGUGAACCUCAA | 166 | csusucacCfcGfGfGfugaaccucsasa | 358 |
| AACCUCAGUCCUAACCGCAAA | 167 | asasccucAfgUfCfCfuaaccgcasasa | 359 |
| ACCUCAGUCCUAACCGCAACA | 168 | ascscucaGfuCfCfUfaaccgcaascsa | 360 |
| CUCAGUCCUAACCGCAACCAA | 169 | csuscaguCfcUfAfAfccgcaaccsasa | 361 |
| CAGACCCACAAGGGUGCCGGA | 170 | csasgaccCfaCfAfAfgggugccgsgsa | 362 |
| AAUGGUCUUAACUACAUAGAA | 171 | asasugguCfuUfAfAfcuacauagsasa | 363 |
| CAAGUGAGGAUUUAAGCGCCA | 172 | csasagugAfgGfAfUfuuaagcgcscsa | 364 |
| GCGCCUAUGCCAGCAUCAGUA | 173 | gscsgccuAfuGfCfCfagcaucagsusa | 365 |
| CACCAACCUCUCACAGCGUUA | 174 | csasccaaCfcUfCfUfcacagcgususa | 366 |
| AGAAUCCAUUAAUGAUCAACA | 175 | asgsaauc CfaUfUfAfaugaucaascsa | 367 |
| AAUGAUCAACCACCUGAGUCA | 176 | asasugauCfaAfCfCfaccugaguscsa | 368 |
| AUCAACCACCUGAGUCAAUAA | 177 | asuscaacCfaCfCfUfgagucaausasa | 369 |
| GAUGAAUGUUAGUUGGAGGUA | 178 | gsasugaaUfgUfUfAfguuggaggsusa | 370 |
| AUGUUAGUUGGAGGUAAUGCA | 179 | asusguuaGfuUfGfGfagguaaugscsa | 371 |
| UAUGACCUUGCCAAGACUAAA | 180 | usasugacCfuUfGfCfcaagacuasasa | 372 |
| AGUAGAACACCGAGGAUAAAA | 181 | asgsuagaAfcAfCfCfgaggauaasasa | 373 |
| GAUAUUGGAGGUGCUUAACCA | 182 | gsasuauuGfgAfGfGfugcuuaacscsa | 374 |
| AUAUUGGAGGUGCUUAACCCA | 183 | asusauugGfaGfGfUfgcuuaaccscsa | 375 |
| ACGAGUAUGCCAUAGGAUAGA | 184 | ascsgaguAfuGfCfCfauaggauasgsa | 376 |
| UGCCAUAGGAUAGGACAAAUA | 185 | usgsccauAfgGfAfUfaggacaaasusa | 377 |
| UUGGCUUAAGAAUGUAGUUCA | 186 | ususggcuUfaAfGfAfauguaguuscsa | 378 |
| UGGCUUAAGAAUGUAGUUCCA | 187 | usgsgcuuAfaGfAfAfuguaguucscsa | 379 |
| UGGCUACAGGGUGGGCCAAAA | 188 | usgsgcuaCfaGfGfGfugggccaasasa | 380 |
| CAGGGUGGGCCAAAUUAAACA | 189 | csasggguGfgGfCfCfaaauuaaascsa | 381 |
| CAUGGUCUGUAUUGCUACCAA | 190 | csasugguCfuGfUfAfuugcuaccsasa | 382 |
| UUUUCUUUAUAGUGUUAUGCA | 191 | ususuucuUfuAfUfAfguguuaugscsa | 383 |
| UAUUAGUGGUCCUUAAUGUCA | 192 | usasuuagUfgGfUfCfcuuaauguscsa | 384 |
| GCAGCAUGGCGAGCCCUCCGG | 458 | gscsagcaUfgGfCfGfagcccuccsgsg | 604 |
| ACGUGCGCAAGGUGGGCUACC | 459 | ascsgugcGfcAfAfGfgugggcuascsc | 605 |

TABLE 2-continued

IRS1 RNAi agent sense strand sequences.

| Sense Sequence (5'→3') | SEQ ID NO: | Modified Sense Sequence (5'→3') | SEQ ID NO: |
|---|---|---|---|
| CGUGCGCAAGGUGGGCUACCU | 460 | csgsugcgCfaAfGfGfugggcuacscsu | 606 |
| CAAGAGCAUGCACAAACGCUU | 461 | csasagagCfaUfGfCfacaaacgcsusu | 607 |
| AAGAGCAUGCACAAACGCUUC | 462 | asasgagcAfuGfCfAfcaaacgcususc | 608 |
| CAUGCACAAACGCUUCUUCGU | 463 | csasugcaCfaAfAfCfgcuucuucsgsu | 609 |
| GCACAAACGCUUCUUCGUACU | 464 | gscsacaaAfcGfCfUfucuucguascsu | 610 |
| ACGAGAAGAAGUGGCGGCACA | 465 | ascsgagaAfgAfAfGfuggcggcascsa | 611 |
| GAGAAGAAGUGGCGGCACAAG | 466 | gsasgaagAfaGfUfGfgcggcacasasg | 612 |
| AGAAGUGGCGGCACAAGUCGA | 467 | asgsaaguGfgCfGfGfcacaagucsgsa | 613 |
| GAAGUGGCGGCACAAGUCGAG | 468 | gsasagugGfcGfGfCfacaagucgsasg | 614 |
| AAGUGGCGGCACAAGUCGAGC | 469 | asasguggCfgGfCfAfcaagucgasgsc | 615 |
| GGGCUGACUCCAAGAACAAGC | 470 | gsgsgcugAfcUfCfCfaagaacaasgsc | 616 |
| GGCUGACUCCAAGAACAAGCA | 471 | gsgscugaCfuCfCfAfagaacaagscsa | 617 |
| GCUGACUCCAAGAACAAGCAC | 472 | gscsugacUfcCfAfAfgaacaagcsasc | 618 |
| CAAGAACAAGCACCUGGUGGC | 473 | csasagaaCfaAfGfCfaccuggugsgsc | 619 |
| ACCUGGUGGCUCUCUACACCC | 474 | ascscuggUfgGfCfUfcucuacacscsc | 620 |
| UGGUGGCUCUCUACACCCGGG | 475 | usgsguggCfuCfUfCfuacacccgsgsg | 621 |
| CCGAGCAAGACAGCUGGUACC | 476 | cscsgagcAfaGfAfCfagcugguascsc | 622 |
| GGACUUGAGCUACGGUGACGU | 477 | gsgsacuuGfaGfCfUfacggugacsgsu | 623 |
| CCCAAGGGCCUGGGUCAGACA | 478 | cscscaagGfgCfCfUfgggucagascsa | 624 |
| CUGGGUCAGACAAAGAACCUG | 479 | csusggguCfaGfAfCfaaagaaccsusg | 625 |
| UGGGUCAGACAAAGAACCUGA | 480 | usgsggucAfgAfCfAfaagaaccusgsa | 626 |
| AACCUGAUUGGUAUCUACCGC | 481 | asasccugAfuUfGfGfuaucuaccsgsc | 627 |
| CCUGAUUGGUAUCUACCGCCU | 482 | cscsugauUfgGfUfAfucuaccgcscsu | 628 |
| GACCAGCAAGACCAUCAGCUU | 483 | gsasccagCfaAfGfAfccaucagcsusu | 629 |
| UCAUCGAGGUGGGCCGUUCUG | 484 | uscsaucgAfgGfUfGfggccguucsusg | 630 |
| GAGUUCCGCCCUCGCAGCAAG | 485 | gsasguucCfgCfCfCfucgcagcasasg | 631 |
| ACGGCGAAGGCACCAUGUCCC | 486 | ascsggcgAfaGfGfCfaccauguc scsc | 632 |
| CGCUCAACCACAGCCGCUCCA | 487 | csgscucaAfcCfAfCfagccgcucscsa | 633 |
| CUCCACCUCGGAUUGUCUCUU | 488 | csusccacCfuCfGfGfauugucucsusu | 634 |
| UGUCUCUUCCCACGGCGAUCU | 489 | usgsucucUfuCfCfCfacggcgauscsu | 635 |
| UUCCCACGGCGAUCUAGUGCU | 490 | ususcccaCfgGfCfGfaucuagugscsu | 636 |
| CAGCGAUGGCGGUUUCAUCUC | 491 | csasgcgaUfgGfCfGfguuucaucsusc | 637 |
| CCAGUCCCUGCGAUUUCCGGA | 492 | cscsagucCfcUfGfCfgauuuccgsgsa | 638 |
| AGUCCCUGCGAUUUCCGGAGU | 493 | asgsucccUfgCfGfAfuuuccggasgsu | 639 |
| GUCCCUGCGAUUUCCGGAGUU | 494 | gsusccuGfcGfAfUfuuccggagsusu | 640 |
| CCUGCGAUUUCCGGAGUUCCU | 495 | cscsugcgAfuUfUfCfcggaguucscsu | 641 |
| GAGUUCCUUCCGCAGUGUCAC | 496 | gsasguucCfuUfCfCfgcagugucsasc | 642 |

TABLE 2-continued

IRS1 RNAi agent sense strand sequences.

| Sense Sequence (5'→3') | SEQ ID NO: | Modified Sense Sequence (5'→3') | SEQ ID NO: |
|---|---|---|---|
| UUCCGCAGUGUCACUCCGGAU | 497 | ususccgcAfgUfGfUfcacuccggsasu | 643 |
| CGCAGUGUCACUCCGGAUUCC | 498 | csgscaguGfuCfAfCfuccggauuscsc | 644 |
| CUGCCUACCCACCAGGAGGUG | 499 | csusgccuAfcCfCfAfccaggaggsusg | 645 |
| GGCAGUGGAGACUAUAUGCCC | 500 | gsgscaguGfgAfGfAfcuauaugcscsc | 646 |
| GUGGAGACUAUAUGCCCAUGA | 501 | gsusggagAfcUfAfUfaugcccausgsa | 647 |
| UCAUCAAUCCCAUCAGACGCC | 502 | uscsaucaAfuCfCfCfaucagacgscsc | 648 |
| CAUCAAUCCCAUCAGACGCCA | 503 | csasucaaUfcCfCfAfucagacgcscsa | 649 |
| UACCUUGCACAGGUGACUACA | 504 | usasccuuGfcAfCfAfggugacuascsa | 650 |
| CUUGCACAGGUGACUACAUGA | 505 | csusugcaCfaGfGfUfgacuacausgsa | 651 |
| UGCACAGGUGACUACAUGAAC | 506 | usgscacaGfgUfGfAfcuacaugasasc | 652 |
| CACAGGUGACUACAUGAACAU | 507 | csascaggUfgAfCfUfacaugaacsasu | 653 |
| CCUUUAAGCACACCCAGCGCC | 508 | cscsuuuaAfgCfAfCfacccagcgscsc | 654 |
| CUUUAAGCACACCCAGCGCCC | 509 | csusuuaaGfcAfCfAfcccagcgcscsc | 655 |
| AGCUCUGGUCGCCUUCUCUAU | 510 | asgscucuGfgUfCfGfccuucucusasu | 656 |
| AGCUGCUCAGACCAAUAGCCG | 511 | asgscugcUfcAfGfAfccaauagcscsg | 657 |
| GCUGCUCAGACCAAUAGCCGC | 512 | gscsugcuCfaGfAfCfcaauagccsgsc | 658 |
| GCAACCAGAGUGCCAAAGUGA | 513 | gscsaaccAfgAfGfUfgccaaagusgsa | 659 |
| GUGCCAAAGUGAUCCGUGCAG | 514 | gsusgccaAfaGfUfGfauccgugcsasg | 660 |
| AAGUGAUCCGUGCAGACCCAC | 515 | asasgugaUfcCfGfUfgcagacccsasc | 661 |
| GAAUGGUCUUAACUACAUAGA | 516 | gsasauggUfcUfUfAfacuacauasgsa | 662 |
| ACCCGCCGCUCAAGUGAGGAU | 517 | ascsccgcCfgCfUfCfaagugaggsasu | 663 |
| CCCGCCGCUCAAGUGAGGAUU | 518 | cscscgccGfcUfCfAfagugaggasusu | 664 |
| UGAGGAUUUAAGCGCCUAUGC | 519 | usgsaggaUfuUfAfAfgcgccuausgsc | 665 |
| AGGAUUUAAGCGCCUAUGCCA | 520 | asgsgauuUfaAfGfCfgccuaugcscsa | 666 |
| GAAUGAAGACCUAAAUGACCU | 521 | gsasaugaAfgAfCfCfuaaaugacscsu | 667 |
| UGAAGACCUAAAUGACCUCAG | 522 | usgsaagaCfcUfAfAfaugaccucsasg | 668 |
| CUAAAUGACCUCAGCAAAUCC | 523 | csusaaauGfaCfCfUfcagcaaauscsc | 669 |
| UUUCAUGAUUCACAACUAGGA | 524 | ususucauGfaUfUfCfacaacuagsgsa | 670 |
| UUCACAACUAGGACCUCAUAU | 525 | ususcacaAfcUfAfGfgaccucausasu | 671 |
| UCCUCAUCAGUAGAUGGUACG | 526 | uscscucaUfcAfGfUfagaugguascsg | 672 |
| CUCAUCAGUAGAUGGUACGAU | 527 | csuscaucAfgUfAfGfaugguacgsasu | 673 |
| CAUCAGUAGAUGGUACGAUGC | 528 | csasucagUfaGfAfUfgguacgausgsc | 674 |
| AUCAGUAGAUGGUACGAUGCA | 529 | asuscaguAfgAfUfGfguacgaugscsa | 675 |
| UCAGUAGAUGGUACGAUGCAU | 530 | uscsaguaGfaUfGfGfuacgaugcsasu | 676 |
| CAUUGACUGAACUGCACGUUC | 689 | csasuugaCfuGfAfAfcugcacgususc | 713 |
| AUUGACUGAACUGCACGUUCU | 690 | asusugacUfgAfAfCfugcacguuscsu | 714 |
| UUGACUGAACUGCACGUUCUA | 691 | ususgacuGfaAfCfUfgcacguucsusa | 715 |

TABLE 2-continued

IRS1 RNAi agent sense strand sequences.

| Sense Sequence (5'→3') | SEQ ID NO: | Modified Sense Sequence (5'→3') | SEQ ID NO: |
|---|---|---|---|
| ACUGCACGUUCUAUAUUGUGC | 692 | ascsugcaCfgUfUfCfuauauugusgsc | 716 |
| GCCCACCACCGUGUCAUGAGA | 693 | gscsccacCfaCfCfGfugucaugasgsa | 717 |
| CCCACCACCGUGUCAUGAGAG | 694 | cscscaccAfcCfGfUfgucaugagsasg | 718 |
| AGUAGAAUAGGGUAUGAUCCU | 695 | asgsuagaAfuAfGfGfguaugaucscsu | 719 |
| AUAUAAGAAUCAUAGUGCCAU | 696 | asusauaaGfaAfUfCfauagugccsasu | 720 |
| UAAGAAUCAUAGUGCCAUAGA | 697 | usasagaaUfcAfUfAfgugccauasgsa | 721 |
| AUAUUUGCUGAUACUAUCUCU | 698 | asusauuuGfcUfGfAfuacuaucuscsu | 722 |
| AUUUGCUGAUACUAUCUCUUG | 699 | asusuugcUfgAfUfAfcuaucucususg | 723 |
| UAAACUAGAUACUGUUGAUCU | 700 | usasaacuAfgAfUfAfcuguugauscsu | 724 |
| UCAGUAGAUGGUACGAUGCAU | 530 | uscsaguaGfaUfGfGfuacgaugcau | 726 |
| CUAAAUGACCUCAGCAAAUCC | 523 | csusaaauGfaCfCfUfcagcaaaucc | 727 |
| UUGACUGAACUGCACGUUCUA | 691 | ususgacuGfaAfCfUfgcacguucua | 728 |
| CAUUGACUGAACUGCACGUUC | 689 | csasuugaCfuGfAfAfcugcacguuc | 729 |
| UGAAGACCUAAAUGACCUCAG | 522 | usgsaagaCfcUfAfAfaugaccucag | 730 |
| ACUGCACGUUCUAUAUUGUGC | 692 | ascsugcaCfgUfUfCfuauauugugc | 731 |

In some embodiments, the antisense strand of the RNAi agent comprises a nucleotide sequence of any of the sequences in Table 1. In some embodiments, the antisense strand comprises a nucleotide sequence set forth in any of SEQ ID NOs: 1-96, 385-457, 677-688, 193-288, 531-603, and 701-712. In some embodiments, the antisense comprises a sequence that has at least at or about 80%, at or about 81%, at or about 82%, at or about 83%, at or about 84%, at or about 85%, at or about 86%, at or about 87%, at or about 88%, at or about 89%, at or about 90%, at or about 91%, at or about 92%, at or about 93%, at or about 94%, at or about 95%, at or about 96%, at or about 97%, at or about 98%, or at or about 99% sequence identity to the sequences set forth in any of SEQ ID NOs: 1-96, 385-457, 677-688, 193-288, 531-603, and 701-712. In some embodiments, the antisense strand or a subsequence thereof of the RNAi agent differs by 0, 1, 2, 3, or 4 nucleotides from an equal length portion of any of the antisense strand sequences set forth in any of SEQ ID NOs: 1-96, 385-457, 677-688, 193-288, 531-603, and 701-712, wherein the subsequence is at least 14, 15, 16, 17, 18, 19, 20, or 21 bases in length.

In some embodiments, the antisense strand of the RNAi agent comprises at least 10, 11, 12, 13, 14, 15, 16, 17, 18, 19, or 20 contiguous bases from any one of SEQ ID NOs: 1-96, 385-457, 677-688, 193-288, 531-603, and 701-712. In some embodiments, the antisense strand comprises, in order, nucleobases 1-14, 1-15, 1-16, 1-17, 1-18, 1-19, 1-20, 1-21, 1-22, 1-23, 2-17, 2-18, 2-19, 2-20, 2-21, 2-22, 2 23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 1-96, 385-457, 677-688, 193-288, 531-603, and 701-712.

In some embodiments, the sense strand of the RNAi agent comprises a nucleotide sequence of any of the sequences in Table 2. In some embodiments, the antisense strand comprises a nucleotide sequence set forth in any of SEQ ID NOs: 97-192, 458-530, 689-700, 289-384, 604-676, 713-724, and 726-731. In some embodiments, the sense strand comprises a sequence that has at least at or about 80%, at or about 81%, at or about 82%, at or about 83%, at or about 84%, at or about 85%, at or about 86%, at or about 87%, at or about 88%, at or about 89%, at or about 90%, at or about 91%, at or about 92%, at or about 93%, at or about 94%, at or about 95%, at or about 96%, at or about 97%, at or about 98%, or at or about 99% sequence identity to the sequences set forth in any of SEQ ID NOs: 97-192, 458-530, 689-700, 289-384, 604-676, and 713-724. In some embodiments, the sense strand or a subsequence thereof of the RNAi agent differs by 0, 1, 2, 3, or 4 nucleotides from an equal length portion of any of the sense strand sequences set forth in any of SEQ ID NOs: 97-192, 458-530, 689-700, 289-384, 604-676, 713-724, and 726-731, wherein the subsequence is at least 14, 15, 16, 17, 18, 19, 20, or 21 bases in length.

In some embodiments, the sense strand of the RNAi agent comprises at least 10, 11, 12, 13, 14, 15, 16, 17, 18, 19, or 20 contiguous bases from any one of SEQ ID NOS: 97-192, 458-530, 689-700, 289-384, 604-676, 713-724, and 726-731. In some embodiments, the sense strand comprises, in order, nucleobases 1-14, 1-15, 1-16, 1-17, 1-18, 1-19, 1-20, 1-21, 1-22, 1-23, 2-17, 2-18, 2-19, 2-20, 2-21, 2-22, 2 23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 97-192, 458-530, 689-700, 289-384, 604-676, 713-724, and 726-731.

Among the RNAi agents provided herein, the RNAi agent comprises an antisense strand comprising a nucleotide sequence having at least at or about 80%, at or about 81%, at or about 82%, at or about 83%, at or about 84%, at or about 85%, at or about 86%, at or about 87%, at or about 88%, at or about 89%, at or about 90%, at or about 91%, at or about 92%, at or about 93%, at or about 94%, at or about 95%, at or about 96%, at or about 97%, at or about 98%, or at or about 99% sequence identity to the sequences set forth in any of SEQ ID NOs: 1-96, 385-457, 677-688, 193-288, 531-603, and 701-712 and a sense strand comprising a nucleotide sequence having at least at or about 80%, at or about 81%, at or about 82%, at or about 83%, at or about 84%, at or about 85%, at or about 86%, at or about 87%, at or about 88%, at or about 89%, at or about 90%, at or about 91%, at or about 92%, at or about 93%, at or about 94%, at or about 95%, at or about 96%, at or about 97%, at or about 98%, or at or about 99% sequence identity to the sequences set forth in any of SEQ ID NOs: 97-192, 458-530, 689-700, 289-384, 604-676, 713-724, and 726-731.

In some embodiments, the antisense strand of the RNAi agent comprises a nucleotide sequence of any of SEQ ID NO: 1-96, 385-457, and 677-688, and the sense strand of the RNAi agent comprises a nucleotide sequence of any of SEQ ID NO: 97-192, 458-530, and 689-700. In some embodiments, the antisense and the sense strands of the RNAi agent comprise the nucleotide sequences of SEQ ID NOs: 1 and 97, respectively; SEQ ID NOs: 2 and 98, respectively; SEQ ID NOs: 3 and 99, respectively; SEQ ID NOs: 4 and 100, respectively; SEQ ID NOs: 5 and 101, respectively; SEQ ID NOs: 6 and 102, respectively; SEQ ID NOs: 7 and 103, respectively; SEQ ID NOs: 8 and 104, respectively; SEQ ID NOs: 9 and 105, respectively; SEQ ID NOs: 10 and 106, respectively; SEQ ID NOs: 11 and 107, respectively; SEQ ID NOs: 12 and 108, respectively; SEQ ID NOs: 13 and 109, respectively; SEQ ID NOs: 14 and 110, respectively; SEQ ID NOs: 15 and 111, respectively; SEQ ID NOs: 16 and 112, respectively; SEQ ID NOs: 17 and 113, respectively; SEQ ID NOs: 18 and 114, respectively; SEQ ID NOs: 19 and 115, respectively; or SEQ ID NOs: 20 and 116, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 21 and 117, respectively; SEQ ID NOs: 22 and 118, respectively; SEQ ID NOs: 23 and 119, respectively; SEQ ID NOs: 24 and 120, respectively; SEQ ID NOs: 25 and 121, respectively; SEQ ID NOs: 26 and 122, respectively; SEQ ID NOs: 27 and 123, respectively; SEQ ID NOs: 28 and 124, respectively; SEQ ID NOs: 29 and 125, respectively; SEQ ID NOs: 30 and 126, respectively; SEQ ID NOs: 31 and 127, respectively; SEQ ID NOs: 32 and 128, respectively; SEQ ID NOs: 33 and 129, respectively; SEQ ID NOs: 34 and 130, respectively; SEQ ID NOs: 35 and 131, respectively; SEQ ID NOs: 36 and 132, respectively; SEQ ID NOs: 37 and 133, respectively; SEQ ID NOs: 38 and 134, respectively; SEQ ID NOs: 39 and 135, respectively; or SEQ ID NOs: 40 and 136, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 41 and 137, respectively; SEQ ID NOs: 42 and 138, respectively; SEQ ID NOs: 43 and 139, respectively; SEQ ID NOs: 44 and 140, respectively; SEQ ID NOs: 45 and 141, respectively; SEQ ID NOs: 46 and 142, respectively; SEQ ID NOs: 47 and 143, respectively; SEQ ID NOs: 48 and 144, respectively; SEQ ID NOs: 49 and 145, respectively; SEQ ID NOs: 50 and 146, respectively; SEQ ID NOs: 51 and 147, respectively; SEQ ID NOs: 52 and 148, respectively; SEQ ID NOs: 53 and 149, respectively; SEQ ID NOs: 54 and 150, respectively; SEQ ID NOs: 55 and 151, respectively; SEQ ID NOs: 56 and 152, respectively; SEQ ID NOs: 57 and 153, respectively; SEQ ID NOs: 58 and 154, respectively; SEQ ID NOs: 59 and 155, respectively; or SEQ ID NOs: 60 and 156, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 61 and 157, respectively; SEQ ID NOs: 62 and 158, respectively; SEQ ID NOs: 63 and 159, respectively; SEQ ID NOs: 64 and 160, respectively; SEQ ID NOs: 65 and 161, respectively; SEQ ID NOs: 66 and 162, respectively; SEQ ID NOs: 67 and 163, respectively; SEQ ID NOs: 68 and 164, respectively; SEQ ID NOs: 69 and 165, respectively; SEQ ID NOs: 70 and 166, respectively; SEQ ID NOs: 71 and 167, respectively; SEQ ID NOs: 72 and 168, respectively; SEQ ID NOs: 73 and 169, respectively; SEQ ID NOs: 74 and 170, respectively; SEQ ID NOs: 75 and 171, respectively; SEQ ID NOs: 76 and 172, respectively; SEQ ID NOs: 77 and 173, respectively; SEQ ID NOs: 78 and 174, respectively; SEQ ID NOs: 79 and 175, respectively; or SEQ ID NOs: 80 and 176, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 81 and 177, respectively; SEQ ID NOs: 82 and 178, respectively; SEQ ID NOs: 83 and 179, respectively; SEQ ID NOs: 84 and 180, respectively; SEQ ID NOs: 85 and 181, respectively; SEQ ID NOs: 86 and 182, respectively; SEQ ID NOs: 87 and 183, respectively; SEQ ID NOs: 88 and 184, respectively; SEQ ID NOs: 89 and 185, respectively; SEQ ID NOs: 90 and 186, respectively; SEQ ID NOs: 91 and 187, respectively; SEQ ID NOs: 92 and 188, respectively; SEQ ID NOs: 93 and 189, respectively; SEQ ID NOs: 94 and 190, respectively; SEQ ID NOs: 95 and 191, respectively; or SEQ ID NOs: 96 and 192, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 385 and 458, respectively; SEQ ID NOs: 386 and 459, respectively; SEQ ID NOs: 387 and 460, respectively; SEQ ID NOs: 388 and 461, respectively; SEQ ID NOs: 389 and 462, respectively; SEQ ID NOs: 390 and 463, respectively; SEQ ID NOs: 391 and 464, respectively; SEQ ID NOs: 392 and 465, respectively; SEQ ID NOs: 393 and 466, respectively; SEQ ID NOs: 394 and 467, respectively; SEQ ID NOs: 395 and 468, respectively; SEQ ID NOs: 396 and 469, respectively; SEQ ID NOs: 397 and 470, respectively; SEQ ID NOs: 398 and 471, respectively; SEQ ID NOs: 399 and 472, respectively; or SEQ ID NOs: 400 and 473, respectively, or any antisense or sense strand that has at least 90% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 401 and 474, respectively; SEQ ID NOs: 402 and 475, respectively; SEQ ID NOs: 403 and 476, respectively; SEQ ID NOs: 404 and 477, respectively; SEQ ID NOs: 405 and 478, respectively; SEQ ID NOs: 406 and 479, respectively; SEQ ID NOs: 407 and 480, respectively; SEQ ID NOs: 408 and 481, respectively; SEQ ID NOs: 409 and 482, respectively; SEQ ID NOs: 410 and 483, respectively; SEQ ID NOs: 411 and 484, respectively; SEQ ID NOs: 412 and 485, respectively; SEQ ID NOs: 413 and 486, respectively; SEQ ID NOs: 414 and 487, respectively; SEQ ID NOs: 415 and 488, respectively; or SEQ ID NOs: 416 and 489, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 417 and 490, respectively; SEQ ID NOs: 418 and 491, respectively; SEQ ID NOs: 419 and 492, respectively; SEQ ID NOs: 420 and 493, respectively; SEQ ID NOs: 421 and 494, respectively; SEQ ID NOs: 422 and 495, respectively; SEQ ID NOs: 423 and 496, respectively; SEQ ID NOs: 424 and 497, respectively; SEQ ID NOs: 425 and 498, respectively; SEQ ID NOs: 426 and 499, respectively; SEQ ID NOs: 427 and 500, respectively; SEQ ID NOs: 428 and 501, respectively; SEQ ID NOs: 429 and 502, respectively; SEQ ID NOs: 430 and 503, respectively; SEQ ID NOs: 431 and 504, respectively; or SEQ ID NOs: 432 and 505, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 433 and 506, respectively; SEQ ID NOs: 434 and 507, respectively; SEQ ID NOs: 435 and 508, respectively; SEQ ID NOs: 436 and 509, respectively; SEQ ID NOs: 437 and 510, respectively; SEQ ID NOs: 438 and 511, respectively; SEQ ID NOs: 439 and 512, respectively; SEQ ID NOs: 440 and 513, respectively; SEQ ID NOs: 441 and 514, respectively; SEQ ID NOs: 442 and 515, respectively; SEQ ID NOs: 443 and 516, respectively; SEQ ID NOs: 444 and 517, respectively; SEQ ID NOs: 445 and 518, respectively; SEQ ID NOs: 446 and 519, respectively; SEQ ID NOs: 447 and 520, respectively; or SEQ ID NOs: 448 and 521, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 449 and 522, respectively; SEQ ID NOs: 450 and 523, respectively; SEQ ID NOs: 451 and 524, respectively; SEQ ID NOs: 452 and 525, respectively; SEQ ID NOs: 453 and 526, respectively; SEQ ID NOs: 454 and 527, respectively; SEQ ID NOs: 455 and 528, respectively; SEQ ID NOs: 456 and 529, respectively; or SEQ ID NOs: 457 and 530, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the antisense and the sense strands of the RNAi agent comprise the nucleotide sequences of SEQ ID NOs: 677 and 689, respectively; SEQ ID NOs: 678 and 690, respectively; SEQ ID NOs: 679 and 691, respectively; SEQ ID NOs: 680 and 692, respectively; SEQ ID NOs: 681 and 693, respectively; SEQ ID NOs: 682 and 694, respectively; SEQ ID NOs: 683 and 695, respectively; SEQ ID NOs: 684 and 696, respectively; SEQ ID NOs: 685 and 697, SEQ ID NOs: 686 and 698, respectively; SEQ ID NOs: 687 and 699, respectively; or SEQ ID NOs: 688 and 700, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto.

In some embodiments, the RNAi agent is prepared or provided as a salt, mixed salt, or a free-acid. In some embodiments, the RNAi agent is prepared as a sodium salt. Such forms are within the scope of the embodiments disclosed herein.

In some embodiments, the IRS1 RNAi agent comprises an antisense strand and a sense strand having the nucleotide sequences of any of the antisense strand/sense strand duplexes of Table 3. In some embodiments, the IRS1 RNAi agent comprises an antisense strand and a sense strand having the nucleotide sequences of any of the antisense strand/sense strand duplexes of Table 3, and further comprises an asialoglycoprotein receptor ligand targeting group. In some embodiments, the IRS1 RNAi agent comprises any of the duplexes of Table 3.

TABLE 3

Examples of IRS1 RNAi agent duplexes.

| Duplex ID NO: | Antisense Strand SEQ ID NO: | Sense Strand SEQ ID NO: | Modified Antisense Strand SEQ ID NO: | Modified Sense Strand SEQ ID NO: |
|---|---|---|---|---|
| 17 | 1 | 97 | 193 | 289 |
| 21 | 2 | 98 | 194 | 290 |
| 28 | 3 | 99 | 195 | 291 |
| 83 | 4 | 100 | 196 | 292 |
| 95 | 5 | 101 | 197 | 293 |
| 96 | 6 | 102 | 198 | 294 |
| 97 | 7 | 103 | 199 | 295 |
| 102 | 8 | 104 | 200 | 296 |
| 103 | 9 | 105 | 201 | 297 |
| 123 | 10 | 106 | 202 | 298 |
| 558 | 11 | 107 | 203 | 299 |
| 560 | 12 | 108 | 204 | 300 |
| 561 | 13 | 109 | 205 | 301 |
| 611 | 14 | 110 | 206 | 302 |
| 744 | 15 | 111 | 207 | 303 |
| 747 | 16 | 112 | 208 | 304 |
| 795 | 17 | 113 | 209 | 305 |
| 854 | 18 | 114 | 210 | 306 |
| 855 | 19 | 115 | 211 | 307 |
| 856 | 20 | 116 | 212 | 308 |
| 860 | 21 | 117 | 213 | 309 |
| 863 | 22 | 118 | 214 | 310 |
| 864 | 23 | 119 | 215 | 311 |
| 865 | 24 | 120 | 216 | 312 |
| 1098 | 25 | 121 | 217 | 313 |
| 1100 | 26 | 122 | 218 | 314 |
| 1115 | 27 | 123 | 219 | 315 |
| 1116 | 28 | 124 | 220 | 316 |

TABLE 3-continued

Examples of IRS1 RNAi agent duplexes.

| Duplex ID NO: | Antisense Strand SEQ ID NO: | Sense Strand SEQ ID NO: | Modified Antisense Strand SEQ ID NO: | Modified Sense Strand SEQ ID NO: |
|---|---|---|---|---|
| 1131 | 29 | 125 | 221 | 317 |
| 1152 | 30 | 126 | 222 | 318 |
| 1156 | 31 | 127 | 223 | 319 |
| 1158 | 32 | 128 | 224 | 320 |
| 1203 | 33 | 129 | 225 | 321 |
| 1232 | 34 | 130 | 226 | 322 |
| 1233 | 35 | 131 | 227 | 323 |
| 1237 | 36 | 132 | 228 | 324 |
| 1294 | 37 | 133 | 229 | 325 |
| 1295 | 38 | 134 | 230 | 326 |
| 1301 | 39 | 135 | 231 | 327 |
| 1411 | 40 | 136 | 232 | 328 |
| 1615 | 41 | 137 | 233 | 329 |
| 1704 | 42 | 138 | 234 | 330 |
| 1891 | 43 | 139 | 235 | 331 |
| 2069 | 44 | 140 | 236 | 332 |
| 2071 | 45 | 141 | 237 | 333 |
| 2073 | 46 | 142 | 238 | 334 |
| 2277 | 47 | 143 | 239 | 335 |
| 2286 | 48 | 144 | 240 | 336 |
| 2301 | 49 | 145 | 241 | 337 |
| 2307 | 50 | 146 | 242 | 338 |
| 2311 | 51 | 147 | 243 | 339 |
| 2312 | 52 | 148 | 244 | 340 |
| 2313 | 53 | 149 | 245 | 341 |
| 2376 | 54 | 150 | 246 | 342 |
| 2379 | 55 | 151 | 247 | 343 |
| 2464 | 56 | 152 | 248 | 344 |
| 2524 | 57 | 153 | 249 | 345 |
| 2580 | 58 | 154 | 250 | 346 |
| 2640 | 59 | 155 | 251 | 347 |
| 2715 | 60 | 156 | 252 | 348 |
| 3018 | 61 | 157 | 253 | 349 |
| 3061 | 62 | 158 | 254 | 350 |
| 3369 | 63 | 159 | 255 | 351 |
| 3390 | 64 | 160 | 256 | 352 |
| 3466 | 65 | 161 | 257 | 353 |
| 3605 | 66 | 162 | 258 | 354 |
| 3620 | 67 | 163 | 259 | 355 |
| 3623 | 68 | 164 | 260 | 356 |
| 3682 | 69 | 165 | 261 | 357 |
| 4295 | 70 | 166 | 262 | 358 |
| 4308 | 71 | 167 | 263 | 359 |
| 4309 | 72 | 168 | 264 | 360 |
| 4311 | 73 | 169 | 265 | 361 |
| 4351 | 74 | 170 | 266 | 362 |
| 4605 | 75 | 171 | 267 | 363 |
| 4747 | 76 | 172 | 268 | 364 |
| 4762 | 77 | 173 | 269 | 365 |
| 7504 | 78 | 174 | 270 | 366 |
| 7649 | 79 | 175 | 271 | 367 |
| 7659 | 80 | 176 | 272 | 368 |
| 7663 | 81 | 177 | 273 | 369 |
| 8319 | 82 | 178 | 274 | 370 |
| 8324 | 83 | 179 | 275 | 371 |
| 8677 | 84 | 180 | 276 | 372 |
| 8750 | 85 | 181 | 277 | 373 |
| 8939 | 86 | 182 | 278 | 374 |
| 8940 | 87 | 183 | 279 | 375 |
| 9157 | 88 | 184 | 280 | 376 |
| 9164 | 89 | 185 | 281 | 377 |
| 9265 | 90 | 186 | 282 | 378 |
| 9266 | 91 | 187 | 283 | 379 |
| 9327 | 92 | 188 | 284 | 380 |
| 9333 | 93 | 189 | 285 | 381 |
| 9453 | 94 | 190 | 286 | 382 |
| 9576 | 95 | 191 | 287 | 383 |
| 9698 | 96 | 192 | 288 | 384 |
| 1078 | 385 | 458 | 531 | 604 |
| 1117 | 386 | 459 | 532 | 605 |
| 1118 | 387 | 460 | 533 | 606 |
| 1148 | 388 | 461 | 534 | 607 |
| 1149 | 389 | 462 | 535 | 608 |

TABLE 3-continued

Examples of IRS1 RNAi agent duplexes.

| Duplex ID NO: | Antisense Strand SEQ ID NO: | Sense Strand SEQ ID NO: | Modified Antisense Strand SEQ ID NO: | Modified Sense Strand SEQ ID NO: |
|---|---|---|---|---|
| 1154 | 390 | 463 | 536 | 609 |
| 1157 | 391 | 464 | 537 | 610 |
| 1228 | 392 | 465 | 538 | 611 |
| 1230 | 393 | 466 | 539 | 612 |
| 1234 | 394 | 467 | 540 | 613 |
| 1235 | 395 | 468 | 541 | 614 |
| 1236 | 396 | 469 | 542 | 615 |
| 1306 | 397 | 470 | 543 | 616 |
| 1307 | 398 | 471 | 544 | 617 |
| 1308 | 399 | 472 | 545 | 618 |
| 1316 | 400 | 473 | 546 | 619 |
| 1327 | 401 | 474 | 547 | 620 |
| 1330 | 402 | 475 | 548 | 621 |
| 1384 | 403 | 476 | 549 | 622 |
| 1523 | 404 | 477 | 550 | 623 |
| 1590 | 405 | 478 | 551 | 624 |
| 1599 | 406 | 479 | 552 | 625 |
| 1600 | 407 | 480 | 553 | 626 |
| 1614 | 408 | 481 | 554 | 627 |
| 1616 | 409 | 482 | 555 | 628 |
| 1643 | 410 | 483 | 556 | 629 |
| 1747 | 411 | 484 | 557 | 630 |
| 1869 | 412 | 485 | 558 | 631 |
| 2074 | 413 | 486 | 559 | 632 |
| 2185 | 414 | 487 | 560 | 633 |
| 2285 | 415 | 488 | 561 | 634 |
| 2298 | 416 | 489 | 562 | 635 |
| 2304 | 417 | 490 | 563 | 636 |
| 2342 | 418 | 491 | 564 | 637 |
| 2380 | 419 | 492 | 565 | 638 |
| 2382 | 420 | 493 | 566 | 639 |
| 2383 | 421 | 494 | 567 | 640 |
| 2386 | 422 | 495 | 568 | 641 |
| 2399 | 423 | 496 | 569 | 642 |
| 2406 | 424 | 497 | 570 | 643 |
| 2409 | 425 | 498 | 571 | 644 |
| 2749 | 426 | 499 | 572 | 645 |
| 2964 | 427 | 500 | 573 | 646 |
| 2968 | 428 | 501 | 574 | 647 |
| 3019 | 429 | 502 | 575 | 648 |
| 3020 | 430 | 503 | 576 | 649 |
| 3259 | 431 | 504 | 577 | 650 |
| 3262 | 432 | 505 | 578 | 651 |
| 3264 | 433 | 506 | 579 | 652 |
| 3266 | 434 | 507 | 580 | 653 |
| 3391 | 435 | 508 | 581 | 654 |
| 3392 | 436 | 509 | 582 | 655 |
| 3462 | 437 | 510 | 583 | 656 |
| 3623 | 438 | 511 | 584 | 657 |
| 3624 | 439 | 512 | 585 | 658 |
| 4324 | 440 | 513 | 586 | 659 |
| 4333 | 441 | 514 | 587 | 660 |
| 4339 | 442 | 515 | 588 | 661 |
| 4604 | 443 | 516 | 589 | 662 |
| 4737 | 444 | 517 | 590 | 663 |
| 4738 | 445 | 518 | 591 | 664 |
| 4751 | 446 | 519 | 592 | 665 |
| 4753 | 447 | 520 | 593 | 666 |
| 4832 | 448 | 521 | 594 | 667 |
| 4835 | 449 | 522 | 595 | 668 |
| 4842 | 450 | 523 | 596 | 669 |
| 4896 | 451 | 524 | 597 | 670 |
| 4904 | 452 | 525 | 598 | 671 |
| 4927 | 453 | 526 | 599 | 672 |
| 4929 | 454 | 527 | 600 | 673 |
| 4931 | 455 | 528 | 601 | 674 |
| 4932 | 456 | 529 | 602 | 675 |
| 4933 | 457 | 530 | 603 | 676 |
| 4993 | 677 | 689 | 701 | 713 |
| 4994 | 678 | 690 | 702 | 714 |
| 4995 | 679 | 691 | 703 | 715 |
| 5003 | 680 | 692 | 704 | 716 |
| 5123 | 681 | 693 | 705 | 717 |

TABLE 3-continued

Examples of IRS1 RNAi agent duplexes.

| Duplex ID NO: | Antisense Strand SEQ ID NO: | Sense Strand SEQ ID NO: | Modified Antisense Strand SEQ ID NO: | Modified Sense Strand SEQ ID NO: |
|---|---|---|---|---|
| 5124 | 682 | 694 | 706 | 718 |
| 5418 | 683 | 695 | 707 | 719 |
| 5468 | 684 | 696 | 708 | 720 |
| 5471 | 685 | 697 | 709 | 721 |
| 5512 | 686 | 698 | 710 | 722 |
| 5514 | 687 | 699 | 711 | 723 |
| 5838 | 688 | 700 | 712 | 724 |
| 1 | 457 | 530 | 603 | 726 |
| 2 | 450 | 523 | 596 | 727 |
| 3 | 679 | 691 | 703 | 728 |
| 4 | 677 | 689 | 701 | 729 |
| 5 | 449 | 522 | 595 | 730 |
| 6 | 680 | 692 | 704 | 731 |

A. Modified Nucleotides

In some embodiments, the RNAi agent comprise an antisense strand and a sense strand, wherein all or substantially all of the nucleotides in the sense strand are modified. In some embodiments, the RNAi agent comprise an antisense strand and a sense strand, wherein all or substantially all of the nucleotides in the antisense strand are modified. In some embodiments, the RNAi agent comprises an antisense strand that comprises a nucleobase sequence differing by 0, 1, 2, 3, or 4 nucleobases from an equal length portion of any of SEQ ID NOs: 1-96, 385-457, and 677-688. In some embodiments, the RNAi agent comprises an antisense strand that comprises a nucleobase sequence differing by 1 nucleobases from any of SEQ ID NOs: 1-96, 385-457, and 677-688. In some embodiments, the RNAi agent comprises a sense strand that comprises a nucleobase sequence differing by 0, 1, 2, 3, or 4 nucleobases from any of SEQ ID NOs: 97-192, 458-530, and 689-700. In some embodiments, the RNAi agent comprises a sense strand that comprises a nucleobase sequence differing by 1 nucleobase from any of SEQ ID NOs: 97-192, 458-530, and 689-700.

In some embodiments, the RNAi agent comprises one or more modified nucleotides. As used herein, a "modified nucleotide" is a nucleotide other than a ribonucleotide (2'-hydroxyl nucleotide). In some embodiments, at least 50% (e.g., at least 60%, at least 70%, at least 80%, at least 90%, at least 95%, at least 97%, at least 98%, at least 99%, or 100%) of the nucleotides are modified nucleotides. As used herein, modified nucleotides include, but are not limited to, deoxyribonucleotides, nucleotide mimics, abasic nucleotides (represented herein as Ab), 2'-modified nucleotides, 3' to 3' linkages (inverted) nucleotides (represented herein as invdN, invN, invn, invAb), nonnatural base-comprising nucleotides, bridged nucleotides, peptide nucleic acids (PNAs), 2',3'seco nucleotide mimics (unlocked nucleobase analogues, represented herein as $N_{UNA\ or}$ NUNA), locked nucleotides (represented herein as $N_{LNA}$ Or NLNA), 3'-O-methoxy (2' internucleoside linked) nucleotides (represented herein as 3'-OMen), 2'-F-Arabino nucleotides (represented herein as NfANA or $Nf_{ANA}$), 5'-Me, 2'-fluoro nucleotide (represented herein as 5Me-Nf), morpholino nucleotides, vinyl phosphonate deoxyribonucleotides (represented herein as vpdN), vinyl phosphonate containing nucleotides, and cyclopropyl phosphonate containing nucleotides (cPrpN). 2'-modified nucleotides (i.e. a nucleotide with a group other than a hydroxyl group at the 2' position of the five-membered sugar ring) include, but are not limited to, 2'-O-methyl nucleotides (represented herein as a lower case letter 'n' in a nucleotide sequence), 2'-deoxy-2'-fluoro nucleotides (represented herein as Nf, also represented herein as 2'-fluoro nucleotide), 2'-deoxy nucleotides (represented herein as dN), 2'-methoxyethyl (2'-O-2-methoxylethyl) nucleotides (represented herein as NM or 2'-MOE), 2'-amino nucleotides, and 2'-alkyl nucleotides. It is not necessary for all positions in a given compound to be uniformly modified. Conversely, more than one modification may be incorporated in a single RNAi agent or even in a single nucleotide thereof. The RNAi agent sense strands and antisense strands may be synthesized and/or modified by methods known in the art. Modification at one nucleotide is independent of modification at another nucleotide.

Modified nucleobases include synthetic and natural nucleobases, such as 5-substituted pyrimidines, 6-azapyrimidines and N-2, N-6 and O-6 substituted purines, (e.g., 2-aminopropyladenine, 5-propynyluracil, or 5-propynylcytosine), 5-methylcytosine (5-me-C), 5hydroxymethyl cytosine, xanthine, hypoxanthine, 2-aminoadenine, 6-alkyl (e.g., 6-methyl, 6-ethyl, 6-isopropyl, or 6-n-butyl) derivatives of adenine and guanine, 2-alkyl (e.g., 2-methyl, 2-ethyl, 2-isopropyl, or 2-n-butyl) and other alkyl derivatives of adenine and guanine, 2-thiouracil, 2-thiothymine, 2-thiocytosine, 5-halouracil, cytosine, 5propynyl uracil, 5propynyl cytosine, 6-azo uracil, 6-azo cytosine, 6-azo thymine, 5-uracil (pseudouracil), 4thiouracil, 8-halo, 8amino, 8-sulfhydryl, 8-thioalkyl, 8-hydroxyl and other 8-substituted adenines and guanines, 5-halo (e.g., 5-bromo), 5-trifluoromethyl, and other 5-substituted uracils and cytosines, 7methylguanine and 7-methyladenine, 8-azaguanine and 8-azaadenine, 7-deazaguanine, 7deazaadenine, 3-deazaguanine, and 3-deazaadenine.

In some embodiments, 3' end and/or 5' end of the sense strand may include additional abasic nucleosides. In some embodiments, an "A" may be added to 3' terminal end of the sense strand. In some embodiments, the one or more abasic nucleosides added to the 3' end or 5' end of the sense strand may be inverted (invAb). In some embodiments, one or more inverted abasic nucleosides may be inserted between the targeting ligand and the nucleobase sequence of the sense strand of the RNAi agent. In some embodiments, the inclusion of one or more inverted abasic nucleosides at or near the terminal end or terminal ends of the sense strand of an RNAi agent may allow for enhanced activity or other desired properties of an RNAi agent.

In some embodiments, 3' end and/or 5' end of the antisense strand may include additional abasic nucleosides. In some embodiments, a "U" may be added to the 5' terminal end of the antisense strand. In some embodiments, the one or more abasic nucleosides added to the 3' end or 5' end of the antisense strand may be inverted (invAb). In some embodiments, one or more inverted abasic nucleosides may be inserted between the targeting ligand and the nucleobase sequence of the sense strand of the RNAi agent. In some embodiments, the inclusion of one or more inverted abasic nucleosides at or near the terminal end or terminal ends of the antisense strand of an RNAi agent may allow for enhanced activity or other desired properties of an RNAi agent.

In some embodiments, the modification comprises fluorinated bases. In some embodiments, 1 or more, 2 or more, 3 or more, 4 or more, 5 or more, 6 or more, 7 or more, 8 or more, 9 or more, or 10 or more bases of the sense strand and/or antisense strand of the RNAi agent are fluorinated. In some embodiments, base 1, 2, 3, 4, 5, 6, 7, 8, 9, 10, 11, 12, 13, 14, 15, 16, 17, 18, 19, and/or 20 of the sense strand of the RNAi agent are fluorinated. In some embodiments, bases 7, 9, 10, and 11 of the sense strand of the RNAi agent are fluorinated. In some embodiments, base 1, 2, 3, 4, 5, 6, 7, 8, 9, 10, 11, 12, 13, 14, 15, 16, 17, 18, 19, and/or 20 of the antisense strand of the RNAi agent are fluorinated. In some embodiments, bases 2, 6, 14, and 16 of the antisense strand are fluorinated.

In some embodiments, the modification comprises 2'-O-methyl (2'-OMe) and/or 2'-deoxy-2'-fluoro (2'-F) ribosugar modifications. In some embodiments, the modification comprises those described in Foster, et al., *Molecular Therapy*. Vol. 26 No 3 Mar. 2018 which is herein incorporated by reference. In some embodiments, all or substantially all of the nucleotides of the RNAi agent are modified nucleotides. As used herein, an RNAi agent wherein substantially all of the nucleotides present are modified nucleotides is an RNAi agent having four or fewer (i.e., 0, 1, 2, 3, or 4) nucleotides in both the sense strand and the antisense strand being ribonucleotides. As used herein, a sense strand wherein substantially all of the nucleotides present are modified nucleotides is a sense strand having two or fewer (i.e., 0, 1, or 2) nucleotides in the sense strand being ribonucleotides. As used herein, an antisense sense strand wherein substantially all of the nucleotides present are modified nucleotides is an antisense strand having two or fewer (i.e., 0, 1, or 2) nucleotides in the sense strand being ribonucleotides. In some embodiments, one or more nucleotides of an RNAi agent is a ribonucleotide.

In some embodiments, the modified antisense strand of the RNAi agent comprises a nucleotide sequence of any of the sequences in Table 1. In some embodiments, the modified sense strand of the RNAi agent comprises a nucleotide sequence of any of the sequences in Table 2.

Among the RNAi agents provided herein, the RNAi agent comprises a modified antisense strand comprising a nucleotide sequence having at least at or about 80%, at or about 81%, at or about 82%, at or about 83%, at or about 84%, at or about 85%, at or about 86%, at or about 87%, at or about 88%, at or about 89%, at or about 90%, at or about 91%, at or about 92%, at or about 93%, at or about 94%, at or about 95%, at or about 96%, at or about 97%, at or about 98%, or at or about 99% sequence identity to the sequences set forth in any of SEQ ID NOs: 193-288, 531-603, and 701-712 and a modified sense strand comprising a nucleotide sequence having at least at or about 80%, at or about 81%, at or about 82%, at or about 83%, at or about 84%, at or about 85%, at or about 86%, at or about 87%, at or about 88%, at or about 89%, at or about 90%, at or about 91%, at or about 92%, at or about 93%, at or about 94%, at or about 95%, at or about 96%, at or about 97%, at or about 98%, or at or about 99% sequence identity to the sequences set forth in any of SEQ ID NOs: 289-384, 604-676, 713-724, and 726-731. Furthermore, among the RNAi agents provided herein, the RNAi agent comprises a modified antisense strand that differs by 1, 2, 3, or 4 nucleotides from an equal length portion of the sequences set forth in any of SEQ ID NOs: 193-288, 531-603, and 701-712, or a subsequence thereof, and a modified sense strand that differs by 1, 2, 3, or 4 nucleotides from an equal length portion of the sequences set forth in any of SEQ ID NOS: 289-384, 604-676, 713-724, and 726-731, or a subsequence thereof.

In some embodiments, the modified antisense strand of the RNAi agent comprises a nucleotide sequence of any of SEQ ID NO: 193-288, 531-603, and 701-712 and the modified sense strand of the RNAi agent comprises a nucleotide sequence of any of SEQ ID NO: 289-384, 604-676, 713-724, and 726-731. In some embodiments, the modified antisense and the modified sense strands of the RNAi agent comprise the nucleotide sequences of SEQ ID NOs: 193 and 289, respectively; SEQ ID NOs: 194 and 290, respectively; SEQ ID NOs: 195 and 291, respectively; SEQ ID NOs: 196 and 292, respectively; SEQ ID NOs: 197 and 293, respectively; SEQ ID NOs: 198 and 294, respectively; SEQ ID NOs: 199 and 295, respectively; SEQ ID NOs: 200 and 296, respectively; SEQ ID NOs: 201 and 297, respectively; SEQ ID NOs: 202 and 298, respectively; SEQ ID NOs: 203 and 299, respectively: SEQ ID NOs: 204 and 300, respectively; SEQ ID NOs: 205 and 301, respectively; SEQ ID NOs: 206 and 302, respectively; SEQ ID NOs: 207 and 303, respectively; SEQ ID NOs: 208 and 304, respectively; SEQ ID NOs: 209 and 305, respectively; SEQ ID NOs: 210 and 306, respectively; SEQ ID NOs: 211 and 307, respectively; or SEQ ID NOs: 212 and 308, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 193 and 289, respectively; SEQ ID NOs: 194 and 290, respectively; SEQ ID NOs: 195 and 291, respectively; SEQ ID NOs: 196 and 292, respectively; SEQ ID NOs: 197 and 293, respectively; SEQ ID NOs: 198 and 294, respectively; SEQ ID NOs: 199 and 295, respectively; SEQ ID NOs: 200 and 296, respectively; SEQ ID NOs: 201 and 297, respectively; SEQ ID NOs: 202 and 298, respectively; SEQ ID NOs: 203 and 299, respectively; SEQ ID NOs: 204 and 300, respectively; SEQ ID NOs: 205 and 301, respectively; SEQ ID NOs: 206 and 302, respectively; SEQ ID NOs: 207 and 303, respectively; SEQ ID NOs: 208 and 304, respectively; SEQ ID NOs: 209 and 305, respectively; SEQ ID NOs: 210 and 306, respectively; SEQ ID NOs: 211 and 307, respectively; or SEQ ID NOs: 212 and 308, respectively.

In some embodiments, the modified antisense and the modified sense strands of the RNAi agent comprise the nucleotide sequences of SEQ ID NOs: 213 and 309, respectively; SEQ ID NOs: 214 and 310, respectively; SEQ ID NOs: 215 and 311, respectively; SEQ ID NOs: 216 and 312, respectively; SEQ ID NOs: 217 and 313, respectively; SEQ ID NOs: 218 and 314, respectively; SEQ ID NOs: 219 and 315, respectively; SEQ ID NOs: 220 and 316, respectively; SEQ ID NOs: 221 and 317, respectively; SEQ ID NOs: 222 and 318, respectively; SEQ ID NOs: 223 and 319, respectively; SEQ ID NOs: 224 and 320, respectively; SEQ ID NOs: 225 and 321, respectively; SEQ ID NOs: 226 and 322, respectively; SEQ ID NOs: 227 and 323, respectively; SEQ ID NOs: 228 and 324, respectively; SEQ ID NOs: 229 and 325, respectively; SEQ ID NOs: 230 and 326, respectively; SEQ ID NOs: 231 and 327, respectively; or SEQ ID NOs: 232 and 328, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 213 and 309, respectively; SEQ ID NOs: 214 and 310, respectively; SEQ ID NOs: 215 and 311, respectively; SEQ ID NOs: 216 and 312, respectively; SEQ ID NOs: 217 and 313, respectively; SEQ ID NOs: 218 and 314, respectively; SEQ ID NOs: 219 and 315, respectively; SEQ ID NOs: 220 and 316, respectively; SEQ ID NOs: 221 and 317, respectively; SEQ ID NOs: 222 and 318, respectively;

SEQ ID NOs: 223 and 319, respectively; SEQ ID NOs: 224 and 320, respectively; SEQ ID NOs: 225 and 321, respectively; SEQ ID NOs: 226 and 322, respectively; SEQ ID NOs: 227 and 323, respectively; SEQ ID NOs: 228 and 324, respectively; SEQ ID NOs: 229 and 325, respectively; SEQ ID NOs: 230 and 326, respectively; SEQ ID NOs: 231 and 327, respectively; or SEQ ID NOs: 232 and 328, respectively.

In some embodiments, the modified antisense and the modified sense strands of the RNAi agent comprise the nucleotide sequences of SEQ ID NOs: 233 and 329, respectively; SEQ ID NOs: 234 and 330, respectively; SEQ ID NOs: 235 and 331, respectively; SEQ ID NOs: 236 and 332, respectively; SEQ ID NOs: 237 and 333, respectively; SEQ ID NOs: 238 and 334, respectively; SEQ ID NOs: 239 and 335, respectively; SEQ ID NOs: 240 and 336, respectively; SEQ ID NOs: 241 and 337, respectively; SEQ ID NOs: 242 and 338, respectively; SEQ ID NOs: 243 and 339, respectively; SEQ ID NOs: 244 and 340, respectively; SEQ ID NOs: 245 and 341, respectively; SEQ ID NOs: 246 and 342, respectively; SEQ ID NOs: 247 and 343, respectively; SEQ ID NOs: 248 and 344, respectively; SEQ ID NOs: 249 and 345, respectively; SEQ ID NOs: 250 and 346, respectively; SEQ ID NOs: 251 and 347, respectively; or SEQ ID NOs: 252 and 348, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 233 and 329, respectively; SEQ ID NOs: 234 and 330, respectively; SEQ ID NOs: 235 and 331, respectively; SEQ ID NOs: 236 and 332, respectively; SEQ ID NOs: 237 and 333, respectively; SEQ ID NOs: 238 and 334, respectively; SEQ ID NOs: 239 and 335, respectively; SEQ ID NOs: 240 and 336, respectively; SEQ ID NOs: 241 and 337, respectively; SEQ ID NOs: 242 and 338, respectively; SEQ ID NOs: 243 and 339, respectively; SEQ ID NOs: 244 and 340, respectively; SEQ ID NOs: 245 and 341, respectively; SEQ ID NOs: 246 and 342, respectively; SEQ ID NOs: 247 and 343, respectively; SEQ ID NOs: 248 and 344, respectively; SEQ ID NOs: 249 and 345, respectively; SEQ ID NOs: 250 and 346, respectively; SEQ ID NOs: 251 and 347, respectively; or SEQ ID NOs: 252 and 348.

In some embodiments, the modified antisense and the modified sense strands of the RNAi agent comprise the nucleotide sequences of SEQ ID NOs: 253 and 349, respectively; SEQ ID NOs: 254 and 350, respectively; SEQ ID NOs: 255 and 351, respectively; SEQ ID NOs: 256 and 352, respectively; SEQ ID NOs: 257 and 353, respectively; SEQ ID NOs: 258 and 354, respectively; SEQ ID NOs: 259 and 355, respectively; SEQ ID NOs: 260 and 356, respectively; SEQ ID NOs: 261 and 357, respectively; SEQ ID NOs: 262 and 358, respectively; SEQ ID NOs: 263 and 359, respectively; SEQ ID NOs: 264 and 360, respectively; SEQ ID NOs: 265 and 361, respectively; SEQ ID NOs: 266 and 362, respectively; SEQ ID NOs: 267 and 363, respectively; SEQ ID NOs: 268 and 364, respectively; SEQ ID NOs: 269 and 365, respectively; SEQ ID NOs: 270 and 366, respectively; SEQ ID NOs: 271 and 367, respectively; or SEQ ID NOs: 272 and 368, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 253 and 349, respectively; SEQ ID NOs: 254 and 350, respectively; SEQ ID NOs: 255 and 351, respectively; SEQ ID NOs: 256 and 352, respectively; SEQ ID NOs: 257 and 353, respectively; SEQ ID NOs: 258 and 354, respectively; SEQ ID NOs: 259 and 355, respectively; SEQ ID NOs: 260 and 356, respectively; SEQ ID NOs: 261 and 357, respectively; SEQ ID NOs: 262 and 358, respectively; SEQ ID NOs: 263 and 359, respectively; SEQ ID NOs: 264 and 360, respectively; SEQ ID NOs: 265 and 361, respectively; SEQ ID NOs: 266 and 362, respectively; SEQ ID NOs: 267 and 363, respectively; SEQ ID NOs: 268 and 364, respectively; SEQ ID NOs: 269 and 365, respectively; SEQ ID NOs: 270 and 366, respectively; SEQ ID NOs: 271 and 367, respectively; or SEQ ID NOs: 272 and 368, respectively.

In some embodiments, the modified antisense and the modified sense strands of the RNAi agent comprise the nucleotide sequences of SEQ ID NOs: 273 and 369, respectively; SEQ ID NOs: 274 and 370, respectively; SEQ ID NOs: 275 and 371, respectively; SEQ ID NOs: 276 and 372, respectively; SEQ ID NOs: 277 and 373, respectively; SEQ ID NOs: 278 and 374, respectively; SEQ ID NOs: 279 and 375, respectively; SEQ ID NOs: 280 and 376, respectively; SEQ ID NOs: 281 and 377, respectively; SEQ ID NOs: 282 and 378, respectively; SEQ ID NOs: 283 and 379, respectively; SEQ ID NOs: 284 and 380, respectively; SEQ ID NOs: 285 and 381, respectively; SEQ ID NOs: 286 and 382, respectively; SEQ ID NOs: 287 and 383, respectively; or SEQ ID NOs: 288 and 384, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 273 and 369, respectively; SEQ ID NOs: 274 and 370, respectively; SEQ ID NOs: 275 and 371, respectively; SEQ ID NOs: 276 and 372, respectively; SEQ ID NOs: 277 and 373, respectively; SEQ ID NOs: 278 and 374, respectively; SEQ ID NOs: 279 and 375, respectively; SEQ ID NOs: 280 and 376, respectively; SEQ ID NOs: 281 and 377, respectively; SEQ ID NOs: 282 and 378, respectively; SEQ ID NOs: 283 and 379, respectively; SEQ ID NOs: 284 and 380, respectively; SEQ ID NOs: 285 and 381, respectively; SEQ ID NOs: 286 and 382, respectively; SEQ ID NOs: 287 and 383, respectively; or SEQ ID NOs: 288 and 384, respectively.

In some embodiments, the RNAi agent is prepared or provided as a salt, mixed salt, or a free-acid. In some embodiments, the RNAi agent is prepared as a sodium salt. Such forms are within the scope of the embodiments disclosed herein.

In some embodiments, the modified antisense and the modified sense strands of the RNAi agent comprise the nucleotide sequences of SEQ ID NOs: 531 and 604, respectively; SEQ ID NOs: 532 and 605, respectively; SEQ ID NOs: 533 and 606, respectively; SEQ ID NOs: 534 and 607, respectively; SEQ ID NOs: 535 and 608, respectively; SEQ ID NOs: 536 and 609, respectively; SEQ ID NOs: 537 and 610, respectively; SEQ ID NOs: 538 and 611, respectively; SEQ ID NOs: 539 and 612, respectively; SEQ ID NOs: 540 and 613, respectively; SEQ ID NOs: 541 and 614, respectively; SEQ ID NOs: 542 and 615, respectively; SEQ ID NOs: 543 and 616, respectively; SEQ ID NOs: 544 and 617, respectively; SEQ ID NOs: 545 and 618, respectively; or SEQ ID NOs: 546 and 619, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 531 and 604, respectively; SEQ ID NOs: 532 and 605, respectively; SEQ ID NOs: 533 and 606, respectively; SEQ ID NOs: 534 and 607, respectively; SEQ ID NOs: 535 and 608, respectively; SEQ ID NOs: 536 and 609, respectively; SEQ ID NOs: 537 and 610, respectively; SEQ ID NOs: 538 and 611, respectively; SEQ ID NOs: 539 and 612, respectively; SEQ ID NOs: 540 and 613, respectively; SEQ ID NOs: 541 and 614, respectively; SEQ ID NOs: 542 and 615, respectively; SEQ ID NOs: 543 and 616, respectively; SEQ ID NOs: 544 and 617, respectively; SEQ ID NOs: 545 and 618, respectively; or SEQ ID NOs: 546 and 619, respectively.

In some embodiments, the modified antisense and the modified sense strands of the RNAi agent comprise the nucleotide sequences of SEQ ID NOs: 547 and 620, respectively; SEQ ID NOs: 548 and 621, respectively; SEQ ID NOs: 549 and 622, respectively; SEQ ID NOs: 550 and 623, respectively; SEQ ID NOs: 551 and 624, respectively; SEQ ID NOs: 552 and 625, respectively; SEQ ID NOs: 553 and 626, respectively; SEQ ID NOs: 554 and 627, respectively; SEQ ID NOs: 555 and 628, respectively; SEQ ID NOs: 556 and 629, respectively; SEQ ID NOs: 557 and 630, respectively; SEQ ID NOs: 558 and 631, respectively; SEQ ID NOs: 559 and 632, respectively; SEQ ID NOs: 560 and 633, respectively; SEQ ID NOs: 561 and 634, respectively; or SEQ ID NOs: 562 and 635, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 547 and 620, respectively; SEQ ID NOs: 548 and 621, respectively; SEQ ID NOs: 549 and 622, respectively; SEQ ID NOs: 550 and 623, respectively; SEQ ID NOs: 551 and 624, respectively; SEQ ID NOs: 552 and 625, respectively; SEQ ID NOs: 553 and 626, respectively; SEQ ID NOs: 554 and 627, respectively; SEQ ID NOs: 555 and 628, respectively; SEQ ID NOs: 556 and 629, respectively; SEQ ID NOs: 557 and 630, respectively; SEQ ID NOs: 558 and 631, respectively; SEQ ID NOs: 559 and 632, respectively; SEQ ID NOs: 560 and 633, respectively; SEQ ID NOs: 561 and 634, respectively; or SEQ ID NOs: 562 and 635, respectively.

In some embodiments, the modified antisense and the modified sense strands of the RNAi agent comprise the nucleotide sequences of SEQ ID NOs: 563 and 636, respectively; SEQ ID NOs: 564 and 637, respectively; SEQ ID NOs: 565 and 638, respectively; SEQ ID NOs: 566 and 639, respectively; SEQ ID NOs: 567 and 640, respectively; SEQ ID NOs: 568 and 641, respectively; SEQ ID NOs: 569 and 642, respectively; SEQ ID NOs: 570 and 643, respectively; SEQ ID NOs: 571 and 644, respectively; SEQ ID NOs: 572 and 645, respectively; SEQ ID NOs: 573 and 646, respectively; SEQ ID NOs: 574 and 647, respectively; SEQ ID NOs: 575 and 648, respectively; SEQ ID NOs: 576 and 649, respectively; SEQ ID NOs: 577 and 650, respectively; or SEQ ID NOs: 578 and 651, respectively, any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 563 and 636, respectively; SEQ ID NOs: 564 and 637, respectively; SEQ ID NOs: 565 and 638, respectively; SEQ ID NOs: 566 and 639, respectively; SEQ ID NOs: 567 and 640, respectively; SEQ ID NOs: 568 and 641, respectively; SEQ ID NOs: 569 and 642, respectively; SEQ ID NOs: 570 and 643, respectively; SEQ ID NOs: 571 and 644, respectively; SEQ ID NOs: 572 and 645, respectively; SEQ ID NOs: 573 and 646, respectively; SEQ ID NOs: 574 and 647, respectively; SEQ ID NOs: 575 and 648, respectively; SEQ ID NOs: 576 and 649, respectively; SEQ ID NOs: 577 and 650, respectively; or SEQ ID NOs: 578 and 651, respectively.

In some embodiments, the modified antisense and the modified sense strands of the RNAi agent comprise the nucleotide sequences of SEQ ID NOs: 579 and 652, respectively; SEQ ID NOs: 580 and 653, respectively; SEQ ID NOs: 581 and 654, respectively; SEQ ID NOs: 582 and 655, respectively; SEQ ID NOs: 583 and 656, respectively; SEQ ID NOs: 584 and 657, respectively; SEQ ID NOs: 585 and 658, respectively; SEQ ID NOs: 586 and 659, respectively; SEQ ID NOs: 587 and 660, respectively; SEQ ID NOs: 588 and 661, respectively; SEQ ID NOs: 589 and 662, respectively; SEQ ID NOs: 590 and 663, respectively; SEQ ID NOs: 591 and 664, respectively; SEQ ID NOs: 592 and 665, respectively; SEQ ID NOs: 593 and 666, respectively; or SEQ ID NOs: 594 and 667, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 579 and 652, respectively; SEQ ID NOs: 580 and 653, respectively; SEQ ID NOs: 581 and 654, respectively; SEQ ID NOs: 582 and 655, respectively; SEQ ID NOs: 583 and 656, respectively; SEQ ID NOs: 584 and 657, respectively; SEQ ID NOs: 585 and 658, respectively; SEQ ID NOs: 586 and 659, respectively; SEQ ID NOs: 587 and 660, respectively; SEQ ID NOs: 588 and 661, respectively; SEQ ID NOs: 589 and 662, respectively; SEQ ID NOs: 590 and 663, respectively; SEQ ID NOs: 591 and 664, respectively; SEQ ID NOs: 592 and 665, respectively; SEQ ID NOs: 593 and 666, respectively; or SEQ ID NOs: 594 and 667, respectively.

In some embodiments, the modified antisense and the modified sense strands of the RNAi agent comprise the nucleotide sequences of SEQ ID NOs: 595 and 668, respectively; SEQ ID NOs: 596 and 669, respectively; SEQ ID NOs: 597 and 670, respectively; SEQ ID NOs: 598 and 671, respectively; SEQ ID NOs: 599 and 672, respectively; SEQ ID NOs: 600 and 673, respectively; SEQ ID NOs: 601 and 674, respectively; SEQ ID NOs: 602 and 675, respectively; or SEQ ID NOs: 603 and 676, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 595 and 668, respectively; SEQ ID NOs: 596 and 669, respectively; SEQ ID NOs: 597 and 670, respectively; SEQ ID NOs: 598 and 671, respectively; SEQ ID NOs: 599 and 672, respectively; SEQ ID NOs: 600 and 673, respectively; SEQ ID NOs: 601 and 674, respectively; SEQ ID NOs: 602 and 675, respectively; or SEQ ID NOs: 603 and 676, respectively.

In some embodiments, the modified antisense and the modified sense strands of the RNAi agent comprise the nucleotide sequences of SEQ ID NOs: 701 and 713, respectively; SEQ ID NOs: 702 and 714, respectively; SEQ ID NOs: 703 and 715, respectively; SEQ ID NOs: 704 and 716, respectively; SEQ ID NOs: 705 and 717, respectively; SEQ ID NOs: 706 and 718, respectively; SEQ ID NOs: 707 and 719, respectively; SEQ ID NOs: 708 and 720, respectively; SEQ ID NOs: 709 and 721, respectively; SEQ ID NOs: 710 and 722, respectively; SEQ ID NOs: 711 and 723, respectively; or SEQ ID NOs: 712 and 724, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 701 and 713, respectively; SEQ ID NOs: 702 and 714, respectively; SEQ ID NOs: 703 and 715, respectively; SEQ ID NOs: 704 and 716, respectively; SEQ ID NOs: 705 and 717, respectively; SEQ ID NOs: 706 and 718, respectively; SEQ ID NOs: 707 and 719, respectively; SEQ ID NOs: 708 and 720, respectively; SEQ ID NOs: 709 and 721, respectively; SEQ ID NOs: 710 and 722, respectively; SEQ ID NOs: 711 and 723, respectively; or SEQ ID NOs: 712 and 724, respectively.

In some embodiments, the modified antisense and the modified sense strands of the RNAi agent comprise the nucleotide sequences of SEQ ID NOs: 603 and 726, respectively; SEQ ID NOs: 596 and 727, respectively; SEQ ID NOs: 703 and 728, respectively; SEQ ID NOs: 701 and 729, respectively; SEQ ID NOs: 595 and 730, respectively; and SEQ ID NOs: 704 and 731, respectively, or any antisense or sense strand that has at least 80% sequence identity to any of the above sequences, such as at least 80%, 81%, 82%, 83%, 84%, 85%, 86%, 87%, 88%, 89%, 90%, 91%, 92%, 93%, 94%, 95%, 96%, 97%, 98%, or 99% sequence identity thereto, or any antisense or sense stand that differs by 1, 2, 3, or 4 nucleotides from an equal length portion of the sequences of SEQ ID NOs: 603 and 726, respectively; SEQ ID NOs: 596 and 727, respectively; SEQ ID NOs: 703 and 728, respectively; SEQ ID NOs: 701 and 729, respectively; SEQ ID NOs: 595 and 730, respectively; and SEQ ID NOs: 704 and 731.

In some embodiments, the IRS1 RNAi agent comprises a modified antisense strand and a modified sense strand having the nucleotide sequences of any of the modified antisense strand and/or modified sense strand nucleotide sequences of any of the duplexes of Table 3. In some embodiments, the duplexes of shown in Table 3 and further comprises an asialoglycoprotein receptor ligand targeting group. In some embodiments, the IRS1 RNAi agent comprises any of the duplexes of Table 3.

B. Modified Internucleoside Linkages and Modified Sugar-Phosphate Backbone

In some embodiments, one or more nucleotides of the RNAi agent are linked by non-standard internucleoside linkages or sugar-phosphate backbones (i.e., modified internucleoside linkages or modified backbones). Although some modifications to standard linkages or backbones can occur naturally, many synthetic modifications in the disclosed oligonucleotides are not found in the disclosed oligonucleotides in nature. The term "synthetically modified" herein refers to modifications not found in nature. An exemplary modified sequence pattern is shown in FIG. 1, which includes phosphorothioate (PTO), 2'-OMe, and 2'-Fluoro modifications. In some embodiments, a modified internucleoside linkage is a non-phosphate-containing covalent internucleoside linkage. Modified internucleoside linkages or backbones include, but are not limited to, 5'-phosphorothioate groups (represented herein as a lower case "s"), chiral phosphorothioates, thiophosphates, phosphorodithioates, phosphotriesters, aminoalkyl-phosphotriesters, alkyl phosphonates (e.g., methyl phosphonates or 3'-alkylene phosphonates), chiral phosphonates, phosphinates, phosphoramidates (e.g., 3'-amino phosphoramidate, aminoalkylphosphoramidates, or thionophosphoramidates), thionoalkyl-phosphonates, thionoalkylphosphotriesters, morpholino linkages, boranophosphates having normal 3'-5' linkages, 2'-5' linked analogs of boranophosphates, or boranophosphates having inverted polarity wherein the adjacent pairs of nucleoside units are linked 3'-5' to 5'-3' or 2'-5' to 5'-2'. In some embodiments, a modified internucleoside linkage or backbone lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some embodiments, modified internucleoside backbones include, but are not limited to, siloxane backbones, sulfide backbones, sulfoxide backbones, sulfone backbones, formacetyl and thioformacetyl backbones, methylene formacetyl and thioformacetyl backbones, alkene-containing backbones, sulfamate backbones, methyleneimino and methylenehydrazino backbones, sulfonate and sulfonamide backbones, amide backbones, and other backbones having mixed N, O, S, and $CH_2$ components.

In some embodiments, the first and/or second internucleoside linkages of the sense strand and/or the first and/or second internucleoside linkages of the antisense strand are modified (e.g., phosphorothioate) linkages. In some embodiments, the final and/or penultimate internucleoside linkages of the sense strand and/or the final and/or penultimate internucleoside linkages of the antisense strand are modified (e.g., phosphorothioate) linkages.

In some embodiments, a sense strand of the RNAi agent comprises 1, 2, 3, 4, 5, or 6 phosphorothioate linkages, an antisense strand of the RNAi agent comprises 1, 2, 3, 4, 5, or 6 phosphorothioate linkages, or both the sense strand and the antisense strand independently comprise 1, 2, 3, 4, 5, or 6 phosphorothioate linkages. In some embodiments, a sense strand of the RNAi agent comprises 1, 2, 3, or 4 phosphorothioate linkages, an antisense strand of the RNAi agent comprises 1, 2, 3, or 4 phosphorothioate linkages, or both the sense strand and the antisense strand independently comprise 1, 2, 3, or 4 phosphorothioate linkages.

In some embodiments, the RNAi agent sense strand comprises at least two phosphorothioate internucleoside linkages. In some embodiments, the at least two phosphorothioate internucleoside linkages are between the nucleotides at positions 1-3 from the 3' end of the sense strand. In some embodiments, the at least two phosphorothioate internucleoside linkages are between the nucleotides at positions 1-3, 2-4, 3-5, 4-6, 4-5, or 6-8 from the 5' end of the sense strand. In some embodiments, the at least two phosphorothioate internucleoside linkages are following bases 1, 2, 19, and 20 of the sense strand. In some embodiments, the RNAi agent antisense strand comprises four phosphorothioate internucleoside linkages. In some embodiments, the four phosphorothioate internucleoside linkages are between the nucleotides at positions 1-3 from the 5' end of the sense strand and between the nucleotides at positions 19-21, 20-22, 21-23, 22-24, 23-25, or 24-26 from the 5' end. In some embodiments, the four phosphorothioate internucleoside linkages are following bases 1, 2, 21, and 22 of the antisense strand. In some embodiments, the RNAi agent comprises at least two phosphorothioate internucleoside linkages in the sense strand and three or four phosphorothioate internucleoside linkages in the antisense strand. In some embodiments, the RNAi agent contains one or more modified nucleotides and one or more modified internucleoside linkages. In some embodiments, a 2'-modified nucleoside is combined with modified internucleoside linkage.

Various implementations provide a modified oligonucleotide having 12 to 30 or 12 to 50 linked nucleosides. The modified oligonucleotide includes at least one synthetically modified internucleoside linkage or at least one synthetically modified sugar-phosphate backbone. The modified oligonucleotide has a nucleobase sequence including at least 12, at least 13, at least 14, at least 15, at least 16, at least 17, at least 18, at least 19, at least 20, at least 21, at least 22, at least 23, at least 24, or at least 25 contiguous nucleobases complementary to an equal length portion of SEQ ID NO: 725 (IRS1).

The modified oligonucleotides described herein encompass a broad range of oligonucleotide-based therapeutics. These include, but are not limited to, small interfering RNA (siRNA), small activating RNA (saRNA), antisense oligonucleotides (ASO), regulatory oligonucleotides, miRNA mimics and inhibitors, ribozymes, DNAzymes, splice-switching oligonucleotides (SSOs), decoy oligonucleotides, aptamers, DNA triplex-forming oligonucleotides (TFOs), etc.

Small activating RNA (saRNA) are short double-stranded RNA molecules designed to upregulate gene expression by targeting promoter regions or enhancer elements. Modifications similar to those used in siRNA can be applied to saRNA to enhance their stability and targeting efficacy, ensuring prolonged activation of gene expression.

Antisense oligonucleotides (ASO) are single-stranded DNA or RNA sequences designed to bind complementary mRNA transcripts, thereby blocking translation or promoting degradation through RNase H activity. ASOs often include modifications such as phosphorothioate backbones, 2'-O-methyl or 2'-O-methoxyethyl sugar modifications, and incorporation of LNAs to improve resistance to nucleases and increase binding affinity.

MicroRNA (miRNA) mimics are synthetic oligonucleotides designed to mimic endogenous miRNAs—small, non-coding RNA molecules typically 19-25 nucleotides in length that play a critical role in regulating gene expression. miRNA mimics can restore the function of miRNAs that are downregulated in certain diseases such as cancer.

MicroRNA inhibitors (antagomirs) are chemically modified, single-stranded oligonucleotides designed to bind and inhibit endogenous miRNAs. They can be used to upregulate target gene expression by blocking miRNA function. Common modifications include locked nucleic acids (LNA), 2'-O-methyl, and phosphorothioate linkages to enhance stability and binding affinity.

Ribozymes are RNA molecules with catalytic activity, capable of cleaving specific RNA sequences. Engineered ribozymes can be designed to target and degrade pathogenic mRNAs, offering a therapeutic avenue for diseases caused by aberrant gene expression.

DNAzymes are DNA oligonucleotides with catalytic functions similar to ribozymes. DNAzymes can be designed to cleave specific RNA sequences, providing a potential therapeutic strategy for inactivating harmful mRNA transcripts. Chemical modifications such as phosphorothioate backbones can improve their stability and efficacy.

Splice-switching oligonucleotides (SSOs) are designed to modulate pre-mRNA splicing, allowing for the correction of aberrant splicing patterns or the exclusion of deleterious exons. By binding to splicing enhancers or silencers, SSOs can restore the expression of functional proteins. Modified backbones such as phosphorodiamidate morpholino oligomers (PMOs) and 2'-O-methoxyethyl modifications are often used to improve their pharmacological properties.

Decoy oligonucleotides are designed to mimic specific regulatory DNA or RNA sequences, competitively binding to transcription factors, RNA-binding proteins, or other regulatory molecules. This can inhibit the interaction of these regulatory molecules with their natural targets, thereby modulating gene expression. These decoys often incorporate modifications to increase their stability and binding affinity.

Aptamers are short nucleic acid sequences that can fold into specific three-dimensional shapes, allowing them to bind their target molecules with high specificity and affinity, akin to antibodies. Aptamers can be used as therapeutic agents to neutralize proteins, interfere with protein-protein interactions, or deliver drugs to specific cells. Modifications such as polyethylene glycol (PEG) conjugation and nucleotide analogs can enhance their stability and prolong their activity in biological systems.

DNA triplex-forming oligonucleotides (TFOs) bind to the major groove of double-stranded DNA, forming a triple-helix structure. This can be used to modulate gene expression by blocking the binding of transcription factors or other DNA-binding proteins, thereby regulating the transcription of target genes. TFOs often include modifications such as 2'-O-methyl or locked nucleic acids to enhance their stability and binding specificity.

Additionally, the modified oligonucleotides are envisioned to include other emerging oligonucleotide-based therapeutics not enumerated above but have the same recited features. Synthetic oligonucleotides are versatile in treating a wide array of diseases. With various chemical modifications, these oligos can be tailored to improve their stability, specificity, and therapeutic efficacy in precision medicine and targeted therapies.

C. Targeting Groups

In some embodiments, the RNAi agent as provided herein is conjugated to one or more non-nucleotide groups including, but not limited to a targeting group, linking group, delivery polymer, or a delivery vehicle. In some embodiments, the targeting group (e.g. targeting ligand) is conjugated to the RNAi agent. The non-nucleotide group can enhance targeting, delivery or attachment of the RNAi agent. Examples of targeting groups are provided in Table 4. The targeting group (e.g. targeting ligand) can be covalently linked to the 3' and/or 5' end of either the sense strand and/or the antisense strand. In some embodiments, the RNAi agent contains a non-nucleotide group linked to 3' and/or 5' end of the sense strand. In some embodiments, a non-nucleotide group is linked to the 5' end of the RNAi agent sense strand. A non-nucleotide group may be linked directly or indirectly to the RNAi agent via a linker/linking group. In some embodiments, a non-nucleotide group is linked to the RNAi agent via a labile, cleavable, or reversible bond or linker. Exemplary targeting groups (e.g., ligands) are disclosed in U.S. Pat. No. 9,771,591, which is incorporated herein in its entirety.

In some embodiments, a non-nucleotide group enhances the pharmacokinetic or biodistribution properties of the RNAi agent or conjugate to which it is attached to improve cell- or tissue-specific distribution and cell-specific uptake of the conjugate. In some embodiments, a non-nucleotide group enhances endocytosis of the RNAi agent. Such moieties include but are not limited to lipid moieties such as a cholesterol moiety (Letsinger et al., (1989) *Proc. Natl. Acid. Sci. USA,* 86:6553-6556), cholic acid (Manoharan et al., (1994) *Biorg. Med. Chem. Let.,* 4:1053-1060), a thioether, e.g., beryl-S-tritylthiol (Manoharan et al., (1992) *Ann. N.Y. Acad. Sci.,* 660:306-309; Manoharan et al., (1993) *Biorg. Med. Chem. Let.,* 3:2765-2770), a thiocholesterol (Oberhauser et al., (1992) *Nucl. Acids Res.,* 20:533-538), an aliphatic chain, e.g., dodecandiol or undecyl residues (Saison-Behmoaras et al., (1991) *EMBO J,* 10:1111-1118; Kabanov et al., (1990) *FEBS Lett.,* 259:327-330; Svinarchuk et al., (1993) *Biochimie,* 75:49-54), a phospholipid, e.g., di-hexadecyl-rac-glycerol or triethyl-ammonium 1,2-di-O-hexadecyl-rac-glycero-3-phosphonate (Manoharan et al., (1995) *Tetrahedron Lett.,* 36:3651-3654; Shea et al., (1990) *Nucl. Acids Res.,* 18:3777-3783), a polyamine or a polyethylene glycol chain (Manoharan et al., (1995) *Nucleosides & Nucleotides,* 14:969-973), or adamantane acetic acid (Manoharan et al., (1995) *Tetrahedron Lett.,* 36:3651-3654), a palmityl moiety (Mishra et al., (1995) *Biochim. Biophys. Acta,* 1264:229-237), or an octadecylamine or hexylamino-carbonyloxycholesterol moiety (Crooke et al., (1996) *J. Pharmacol. Exp. Ther.,* 277:923-937).

Targeting groups or targeting moieties enhance the pharmacokinetic or biodistribution properties of a conjugate to which they are attached to improve cell-specific distribution and cell-specific uptake of the conjugate. In some embodiments, the targeting group provides an enhanced affinity for a selected target, e.g., molecule, cell or cell type, compartment, e.g., a cellular or organ compartment, tissue, organ or region of the body, as, e.g., compared to a species absent such a targeting group. In some embodiments, the targeting group will not take part in duplex pairing in a duplexed nucleic acid.

Targeting groups can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl) methacrylamide copolymer (HMPA), polyethylene glycol (PEG), polyvinyl alcohol (PVA), polyurethane, poly(2-ethylacryllic acid), N-isopropylacrylamide polymers, or polyphosphazine. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

A targeting group can be monovalent, divalent, trivalent, tetravalent, or have higher valency. Representative targeting groups include, without limitation, compounds with affinity to cell surface molecule, cell receptor ligands, hapten, antibodies, monoclonal antibodies, antibody fragments, and antibody mimics with affinity to cell surface molecules. In some embodiments, the targeting group is a thyrotropin, melanotropin, lectin, glycoprotein, surfactant protein A, Mucin carbohydrate, multivalent lactose, multivalent galactose, N-acetyl-galactosamine, N-acetyl-gulucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Targeting groups can be proteins, e.g., glycoproteins, or peptides, e.g., molecules having a specific affinity for a co-ligand, or antibodies e.g., an antibody, that binds to a specified cell type such as a hepatic cell. Targeting groups can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The targeting group can be a substance, e.g., a drug, which can increase the uptake of the iRNA agent into the cell, for example, by disrupting the cell's cytoskeleton, e.g., by disrupting the cell's microtubules, microfilaments, and/or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a targeting group is linked to the RNAi agent using a linker, such as a PEG linker or one, two, or three abasic and/or ribitol (abasic ribose) groups. In some embodiments, a targeting group comprises a galactose derivative cluster.

The RNAi agent described herein may be synthesized having a reactive group, such as an amine group, at 5'-terminus. The reactive group may be used to subsequently attach a targeting moiety using methods typical in the art.

In some embodiments, a targeting group comprises an asialoglycoprotein receptor ligand. In some embodiments, an asialoglycoprotein receptor ligand includes or comprises of one or more galactose derivatives. As used herein, the term galactose derivative includes both galactose and derivatives of galactose having affinity for the asialoglycoprotein receptor that is equal to or greater than that of galactose. Galactose derivatives include, but are not limited to, galactose, galactosamine, N-formylgalactosamine, N-acetyl-galactosamine, Npropionyl-galactosamine, N-n-butanoyl-galactosamine, and N-iso-butanoylgalactos-amine (see for example: Iobst, S. T. and Drickamer, K. *J.B.C.* 1996, 271, 6686). Galactose derivatives, and clusters of galactose derivatives, that are useful for in vivo targeting of oligonucleotides and other molecules to the liver are known in the art (see, for example, Baenziger and Fiete, 1980, Cell, 22, 611-620; Connolly et al., 1982, J. Biol. Chem., 257, 939-945). Galactose derivatives have been used to target molecules to hepatocytes in vivo through their binding to the asialoglycoprotein receptor (ASGPr) expressed on the surface of hepatocytes. Binding of ASGPr ligands to the ASGPr(s) facilitates cell-specific targeting to hepatocytes and endocytosis of the molecule into hepatocytes. ASGPr ligands can be monomeric (e.g., having a single galactose derivative) or multimeric (e.g., having multiple galactose derivatives). The galactose derivative or galactose derivative cluster may be attached to 3' or 5' end of the RNAi polynucleotide using methods known in the art. The preparation of targeting groups, such as galactose derivative clusters, is described in, for example, U.S. patent application Ser. Nos. 15/452,324 and 15/452,423, the contents of both of which are incorporated herein in their entirety.

In some embodiments, the RNAi agent are targeted to hepatocytes by using conjugated targeting ligands.

In some embodiments, a galactose derivative cluster comprises a molecule having two to four terminal galactose derivatives. A terminal galactose derivative is attached to a molecule through its C-1 carbon. In some embodiments, the galactose derivative cluster is a galactose derivative trimer (also referred to as tri-antennary galactose derivative or tri-valent galactose derivative). In some embodiments, the galactose derivative cluster comprises N-acetyl-galactosamines. In some embodiments, the galactose derivative cluster comprises three N-acetyl-galactosamines. In some embodiments, the galactose derivative cluster is a galactose derivative tetramer (also referred to as tetra-antennary galactose derivative or tetra-valent galactose derivative). In some embodiments, the galactose derivative cluster comprises four N-acetyl-galactosamines.

In some embodiments, a galactose derivative trimer contains three galactose derivatives, each linked to a central branch point. As used herein, a galactose derivative tetramer contains four galactose derivatives, each linked to a central branch point. The galactose derivatives can be attached to the central branch point through the C-1 carbons of the saccharides. In some embodiments, the galactose derivatives are linked to the branch point via linkers or spacers. In some embodiments, the linker or spacer is a flexible hydrophilic spacer, such as a PEG group (see, for example, U.S. Pat. No. 5,885,968; Biessen et al. J. Med. Chem. 1995 Vol. 39 p. 1538-1546). In some embodiments, the PEG spacer is a $PEG_3$ spacer. The branch point can be any small molecule which permits attachment of three galactose derivatives and further permits attachment of the branch point to the RNAi agent. An example of branch point group is a di-lysine or di-glutamate. Attachment of the branch point to the RNAi agent can occur through a linker or spacer. In some embodiments, the linker or spacer comprises a flexible hydrophilic spacer, such as, but not limited to, a PEG spacer. In some embodiments, the linker comprises a rigid linker, such as a cyclic group. In some embodiments, a galactose derivative comprises or consists of N-acetyl-galactosamine. In some embodiments, the galactose derivative cluster is comprised of a galactose derivative tetramer, which can be, for example, an N-acetyl-galactosamine tetramer. In some embodiments, the galactose derivative cluster is comprised of a galactose derivative trimer, which can be, for example, an N-acetyl-galactosamine trimer.

Targeting ligands include, but are not limited to, (PAZ), (NAG13), (NAG13)s, (NAG18), (NAG18)s, (NAG24), (NAG24)s, (NAG25), (NAG25)s, (NAG26), (NAG26)s, (NAG27), (NAG27)s, (NAG28), (NAG28)s, (NAG29), (NAG29)s, (NAG30), (NAG30)s, (NAG31), (NAG31)s, (NAG32), (NAG32)s, (NAG33), (NAG33)s, (NAG34), (NAG34)s, (NAG35), (NAG35)s, (NAG36), (NAG36)s, (NAG37), (NAG37)s, (NAG38), (NAG38)s, (NAG39), and (NAG39) s. Other targeting groups, including galactose cluster targeting ligands, are known in the art.

In a particularly useful implementation, the targeting ligand has a structure according to Formula I:

Formula I

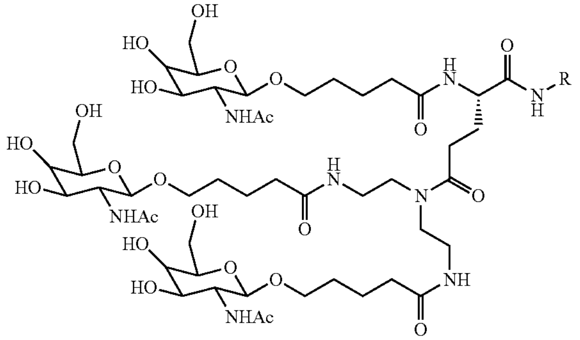

See WO 2022/271806 A1, which is incorporated herein by reference. Formula I may have modifications or additions or deletions of one or more atoms within Formula I, or the compounds may comprise additional moieties. For example, one or more alkyl chains in Formula I may be extended or shortened, or the compound comprising Formula I may further comprise one or more RNAi agents as described herein. The compounds herein comprising Formula I are useful for delivering one or more described RNAi agents to a cell that has a receptor for one or more N-acetylgalactosamine (GalNAc, also N-GalNAc or galnac) moieties, such as the asialoglycoprotein receptor (ASPGR) that typically binds three GalNAc moieties. Accordingly, the compounds comprising Formula I herein may be used to preferentially bind to liver cells that express ASPGR, thereby facilitating entry of the compounds into liver cells. As ASPGR is also present on adipose tissue, the compounds of Formula I thus may be used to deliver RNAi agents to fat cells that express ASPGR.

In one embodiment of an RNAi agent described herein, R of Formula I is a compound comprising one or more oligonucleotides of an RNAi agent described herein. A linker, for example as further described herein, may be used to link Formula I to the one or oligonucleotides described herein. In a suitable further embodiment, the delivery moiety comprising Formula I delivers the one or more RNAi agents to liver tissue, by binding to the extracellular receptor ASPGR and permitting entry of the RNAi agents into the cells that comprise the liver tissue. The delivery moiety comprising Formula I can be used to deliver RNAi agents for diagnostic or therapeutic purposes.

In one embodiment is a compound comprising Formula I, wherein R is an oligonucleotide (e.g., an oligonucleotide comprising a sense strand and an antisense strand) linked to the remainder of Formula I either directly or through a linker, for decreasing expression of a target transcript. In a further embodiment the compound comprising Formula I, wherein R is an oligonucleotide (e.g., an oligonucleotide comprising a sense strand and an antisense strand) linked to the remainder of Formula I either directly or through a linker, for decreasing expression of a target transcript which further decreases protein expression.

In some embodiments R is conjugated to Formula I via a linker. Suitable linkers are known in the art, examples of which are described herein. In one embodiment, the linker comprises an alkyl chain, suitably C1-10. In a further embodiment, the linker is shown below as Linker 1, Formula II. In another embodiment the linker comprises a piperidine. In a further suitable embodiment, the linker is shown below as Linker 2, Formula III. In some embodiments, R is conjugated to Formula I via Formula III (also referred to herein as "Formula IV").

D. Linking Groups

In some embodiments, the RNAi agent as provided herein is conjugated to a linking group. Examples of linking groups are provided in Table 4. The linking group can be covalently linked to 3' and/or 5' end of either the sense strand and/or the antisense strand. Exemplary linking groups are disclosed in U.S. Pat. No. 9,771,591, which is incorporated herein in its entirety.

In some embodiments, a linking group is conjugated to the RNAi agent. The linking group facilitates covalent linkage of the agent to a targeting group or delivery polymer or delivery vehicle. The linking group can be linked to 3' or 5' end of the RNAi agent sense strand or antisense strand. In some embodiments, the linking group is linked to the RNAi agent sense strand. In some embodiments, the linking group is conjugated to the 5' or 3' end of an RNAi agent sense strand. In some embodiments, a linking group is conjugated to the 5' end of an RNAi agent sense strand. Examples of linking groups, include, but are not limited to: reactive groups such a primary amines and alkynes, alkyl groups, abasic nucleosides, ribitol (abasic ribose), and/or PEG groups.

A linker or linking group is a connection between two atoms that links one chemical group (such as an RNAi agent) or segment of interest to another chemical group (such as a targeting group or delivery polymer) or segment of interest via one or more covalent bonds. A labile linkage contains a labile bond. A linkage may optionally include a spacer that increases the distance between the two joined atoms. A spacer may further add flexibility and/or length to the linkage. Spacers may include, but are not be limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description.

In some embodiments, the linker comprises a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, substituted or unsubstituted heterocyclic; where R8 is hydrogen, acyl, aliphatic or substituted aliphatic. In one embodiment, the linker is between about 1-24 atoms, 2-24, 3-24, 4-24, 5-24, 6-24, 6-18, 7-18, 8-18 atoms, 7-17, 8-17, 6-16, 7-17, or 8-16 atoms.

In some embodiments, the linker is a cleavable linker (also referred to herein as a "cleavable linking group" that is sufficiently stable outside the cell, but which upon entry into a target cell is cleaved to release the two parts the linker is holding together. In some embodiments, the cleavable linker is cleaved at least about 10 times, 20, times, 30 times, 40 times, 50 times, 60 times, 70 times, 80 times, 90 times or more, or at least about 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In some embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

In some embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O—, —S—P(S)(H)—O—, —S—P(O)(H)—S—, —O—P(S)(H)—S—. A preferred embodiment is —O—P(O)(OH)—O—. These candidates can be evaluated using methods analogous to those described above.

In some embodiments, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.75, 5.5, 5.25, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

In some embodiments, a cleavable linker comprises an ester-based cleavable linking group. An ester-based cleavable linking group is cleaved by enzymes such as esterases and amidases in cells. Examples of ester-based cleavable linking groups include but are not limited to esters of alkylene, alkenylene and alkynylene groups. Ester cleavable linking groups have the general formula —C(O)O—, or —OC(O)—. These candidates can be evaluated using methods analogous to those described above.

In some embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O) NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, the RNAi agent nucleotide sequences comprises a 3' or 5' targeting ligand and/or linking group. In some embodiments, the RNAi agent nucleotide sequence does not comprise a 3' or 5' targeting ligand and/or linking group. In some embodiments, the targeting ligand or linking group may be attached to 3' or 5' terminus of either the sense strand or the antisense strand of the RNAi agent duplex.

In an exemplary embodiment, the linker is shown below as Linker 1, Formula II. In another embodiment the linker comprises a piperidine. In a further suitable embodiment, the linker is shown below as Linker 2, Formula III.

Formula II

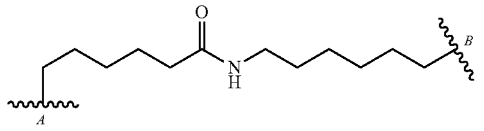

Formula III

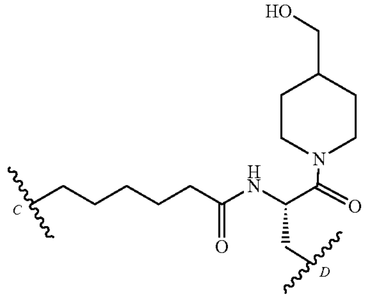

In an embodiment Linker 1 (Formula II), connection point A, or Linker 2 (Formula III), connection point C, is conjugated to Formula I. In an embodiment Linker 1, connection point A, is conjugated to Formula I and connection point B is conjugated to R (e.g., an oligonucleotide). In an embodiment Linker 2, connection point C, is conjugated to Formula I and connection point D is conjugated to R (e.g., an oligonucleotide). In an embodiment Linker 1, connection point A, is conjugated to Formula I and connection point B is conjugated to a phosphate group which is conjugated to R. In an embodiment Linker 2, connection point C, is conjugated to Formula I and connection point D is conjugated to a phosphate group which is conjugated to R. One of skill in the art will recognize that the linker may be on 5' or 3' end of an oligonucleotide, or attached to one of the internal nucleotide or nucleoside bases.

One of skill in the art will also recognize that the linker maybe linked or conjugated to the 5' or 3' end of an oligonucleotide. One of skill in the art will also recognize that placement of a delivery moiety, such as the delivery moieties comprising Formula I, whether via a linker or not, on 5' end an oligonucleotide may need to overcome potential inefficient loading of Ago2 loading, or other hindrance of the RISC complex activity. For example, for a delivery moiety comprising Formula I linked or directly conjugated to an siRNA comprising a sense and an antisense strand, placement of the delivery moiety at the 5' end of the antisense strand may create difficulties for Ago2 loading and prevent efficient knockdown. In a suitable embodiment, the one or more oligonucleotides comprise an siRNA comprising a sense and an antisense strand, and the delivery moiety comprising Formula I is present on 3' end of the sense strand. In a further embodiment, the delivery moiety comprising Formula I is conjugated to the 3' end of the sense strand via a linker. In yet a further embodiment the linker comprises a ring structure, suitably a piperidine ring. In yet a further embodiment, the linker comprises Linker 2.

Additional examples of targeting ligands, linking groups, and combinations thereof are provided in Table 4. In some embodiments, the targeting ligand and linking group combination comprises Formula IV. In some embodiments, the targeting ligand and linking group combination comprises Formula V. In some embodiments, the targeting ligand linking group combination comprises Formula VI.

TABLE 4

Structures representing various modified nucleotides, targeting groups, linking groups, and combinations of targeting groups and linking groups.

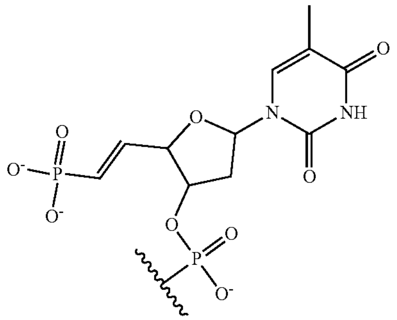

vpdT

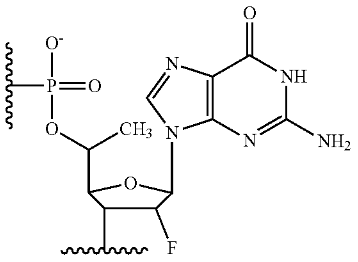

5Me-Gf

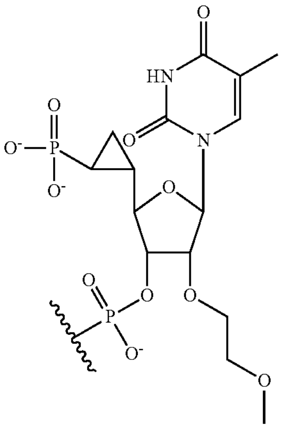

cPrpTM

TABLE 4-continued
| Structures representing various modified nucleotides, targeting groups, linking groups, and combinations of targeting groups and linking groups. |
| --- |
| 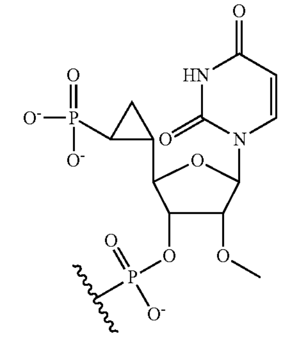 |
| cPrpu |
| 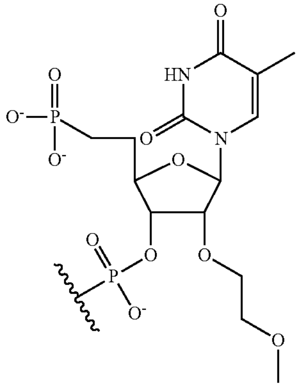 |
| epTM |
| 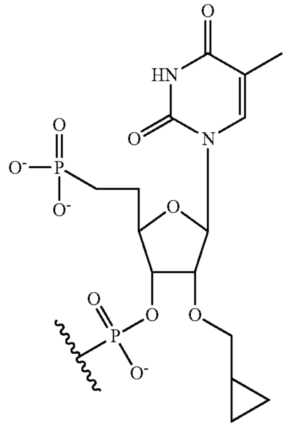 |
| epTcPr |
| When positioned internally on oligonucleotide: |
| 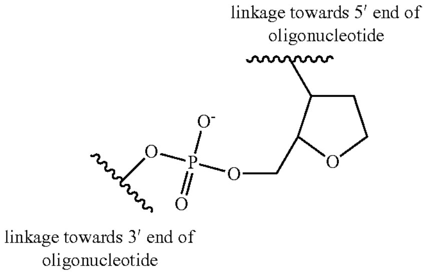 [SMILES: *OP(=O)([O-])OCC1OCCC1*] |

TABLE 4-continued

Structures representing various modified nucleotides, targeting groups, linking groups, and combinations of targeting groups and linking groups.

(invAb)
When positioned internally on oligonucleotide:

linkage towards 5′ end of oligonucleotide

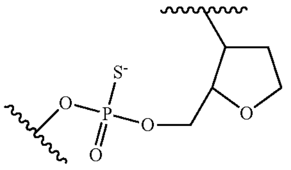

linkage towards 3′ end of oligonucleotide (invAb)s
When positioned at the 3′ terminal end of oligonucleotide:

linkage towards 5′ end of oligonucleotide

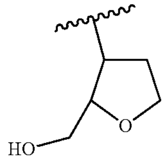

(invAb)

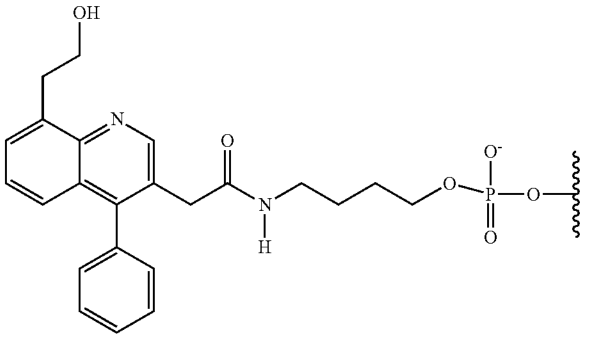 [SMILES: *OP(=O)([O-])OCCCCNC(=O)Cc1cnc2c(CCO)cccc2c1-c1ccccc1]

(PAZ)

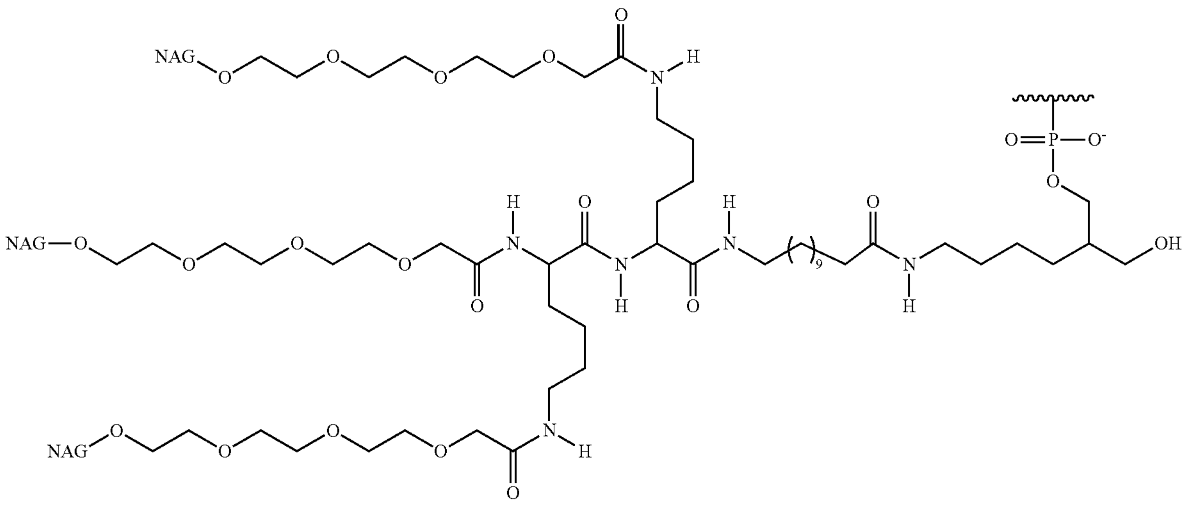

TABLE 4-continued
Structures representing various modified nucleotides, targeting groups, linking groups, and combinations of targeting groups and linking groups.
(NAG13)
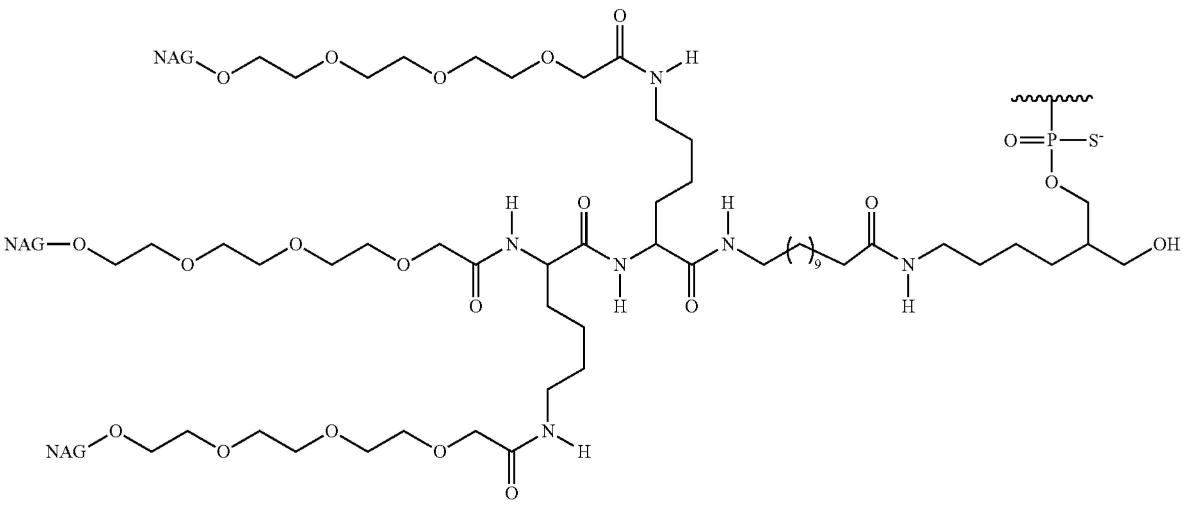
(NAG13)s
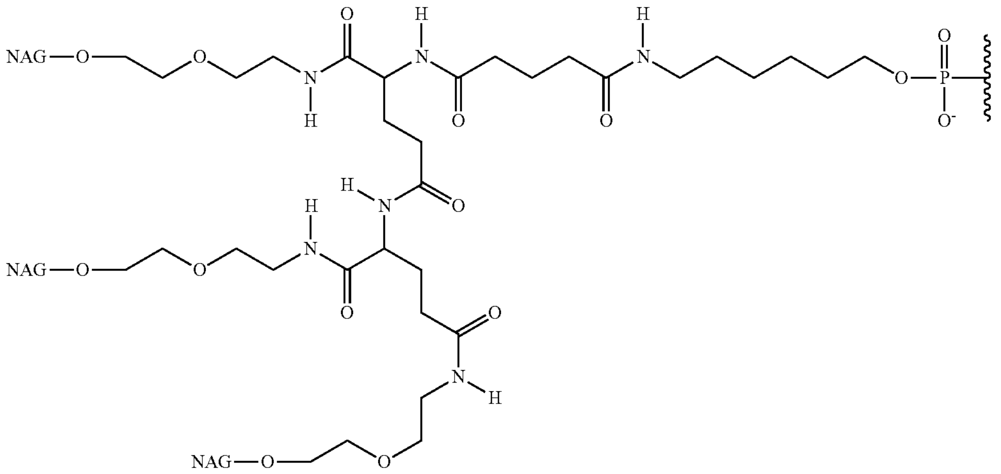
(NAG18)
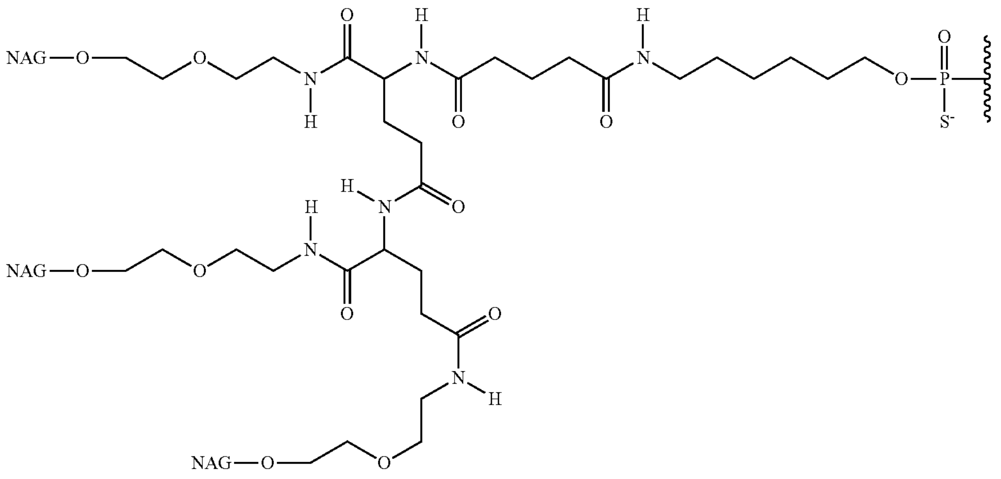

TABLE 4-continued
Structures representing various modified nucleotides, targeting groups, linking groups, and combinations of targeting groups and linking groups.
(NAG18)s
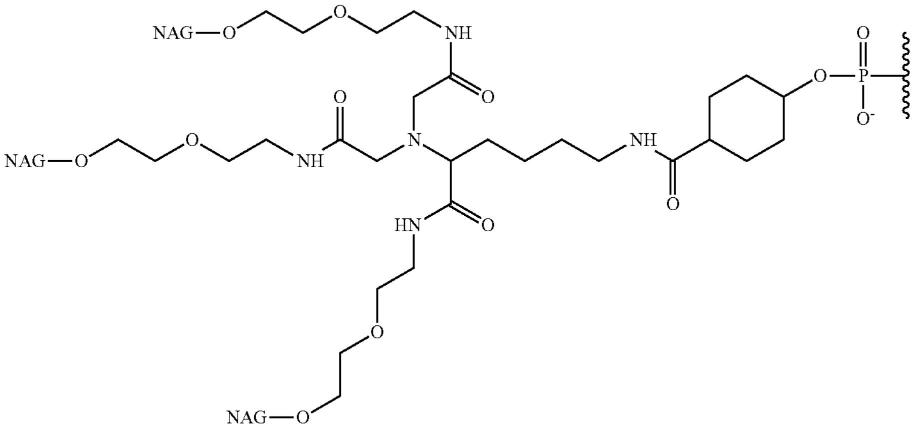
(NAG24)
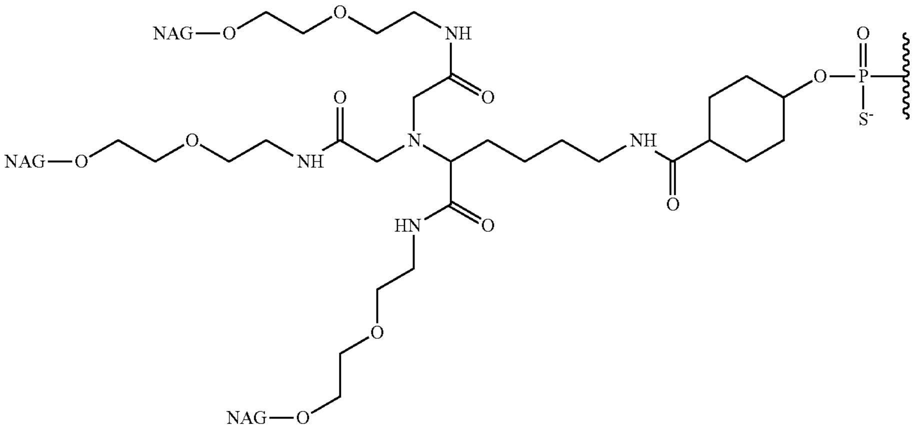
(NAG24)s
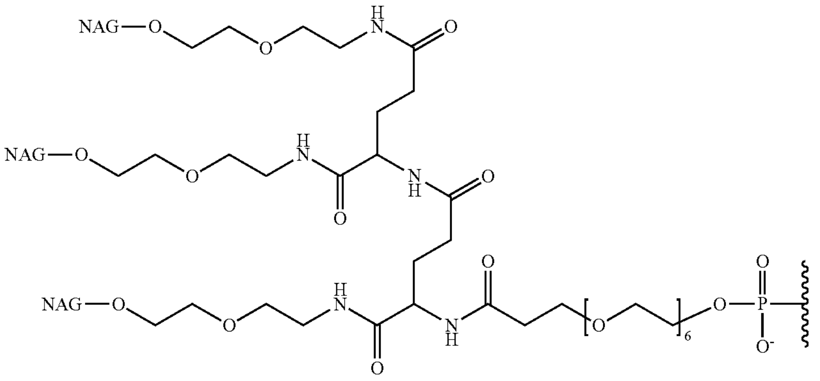
(NAG25)

TABLE 4-continued
Structures representing various modified nucleotides, targeting groups, linking groups, and combinations of targeting groups and linking groups.
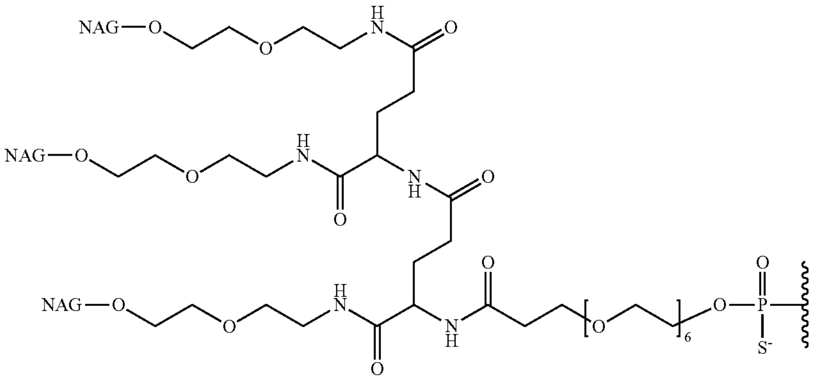
(NAG25)s
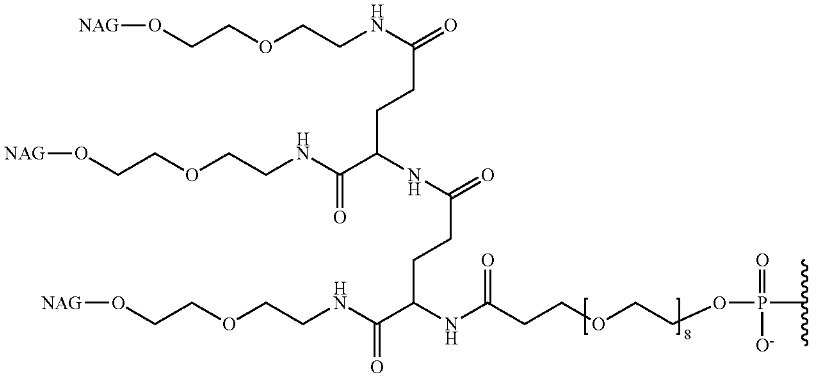
(NAG26)
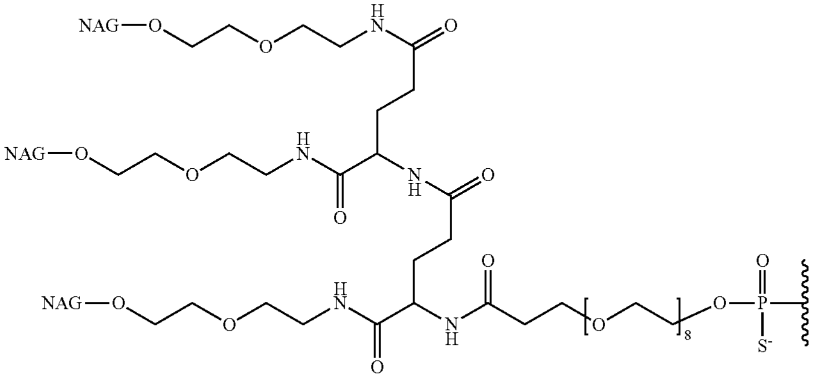
(NAG26)s TABLE 4-continued
| Structures representing various modified nucleotides, targeting groups, linking groups, and combinations of targeting groups and linking groups. |
|---|
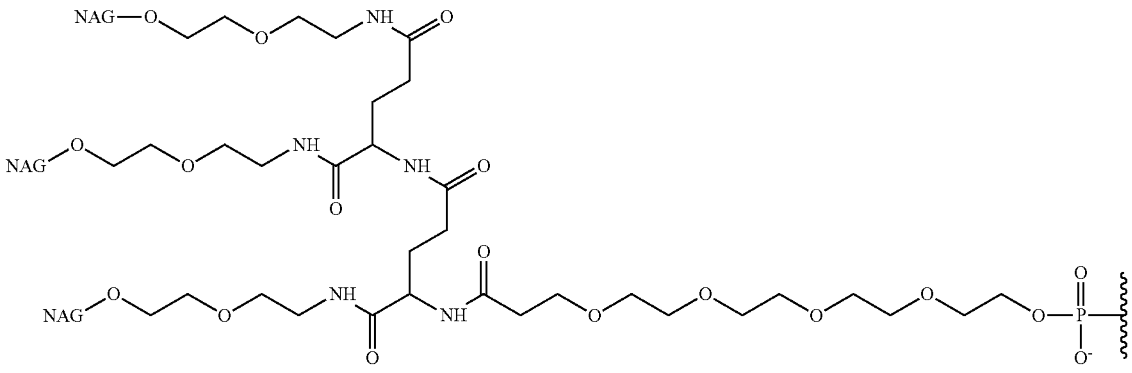
(NAG27)
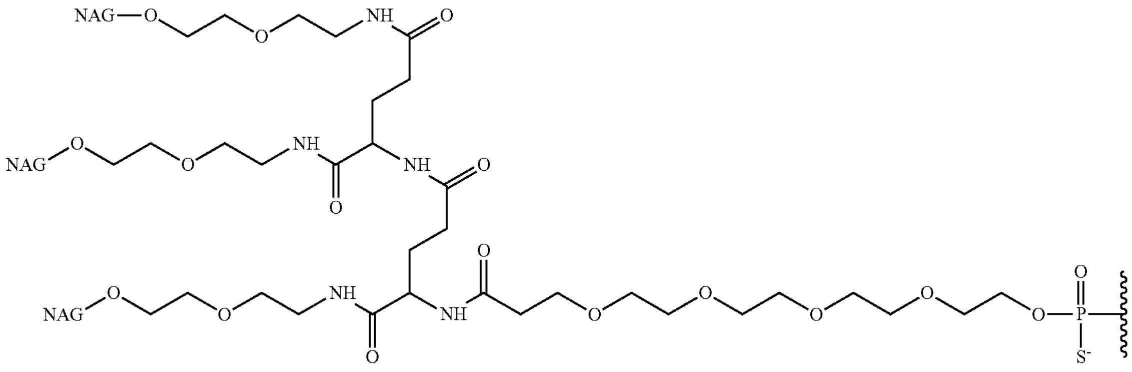
(NAG27)s
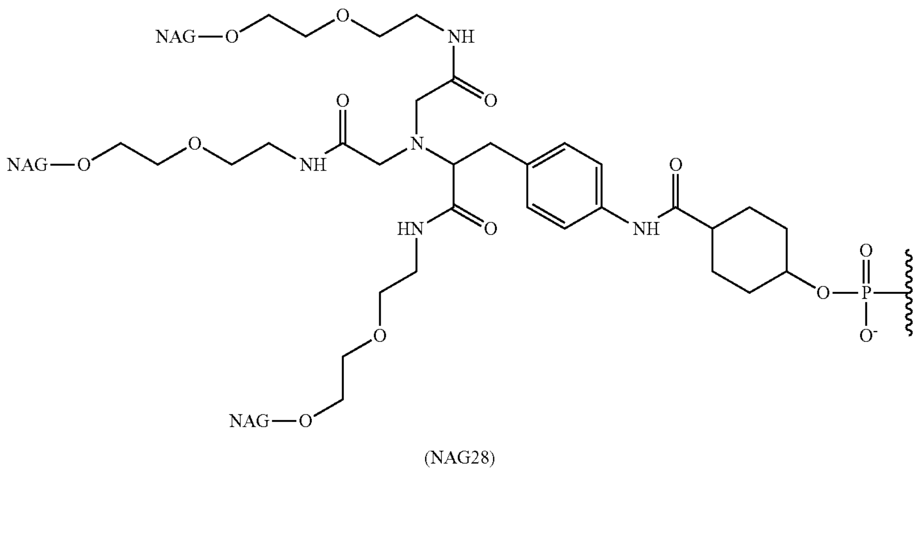
(NAG28)

TABLE 4-continued
| Structures representing various modified nucleotides, targeting groups, linking groups, and combinations of targeting groups and linking groups. |
| --- |
| 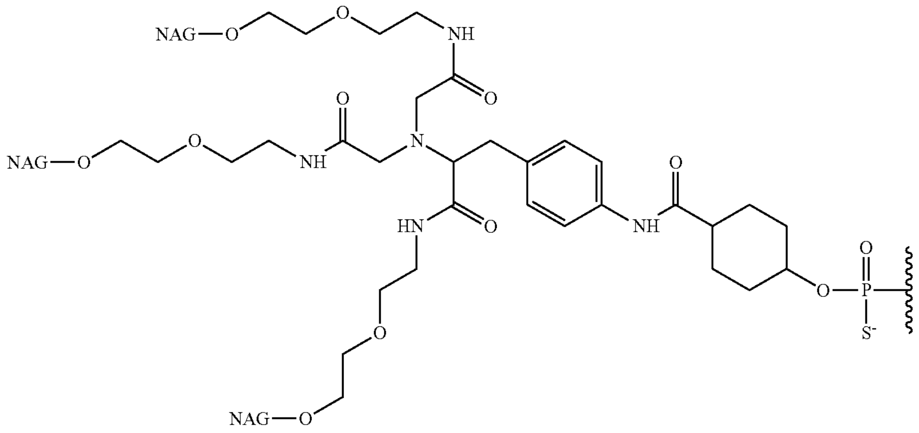 |
| (NAG28)s |
| 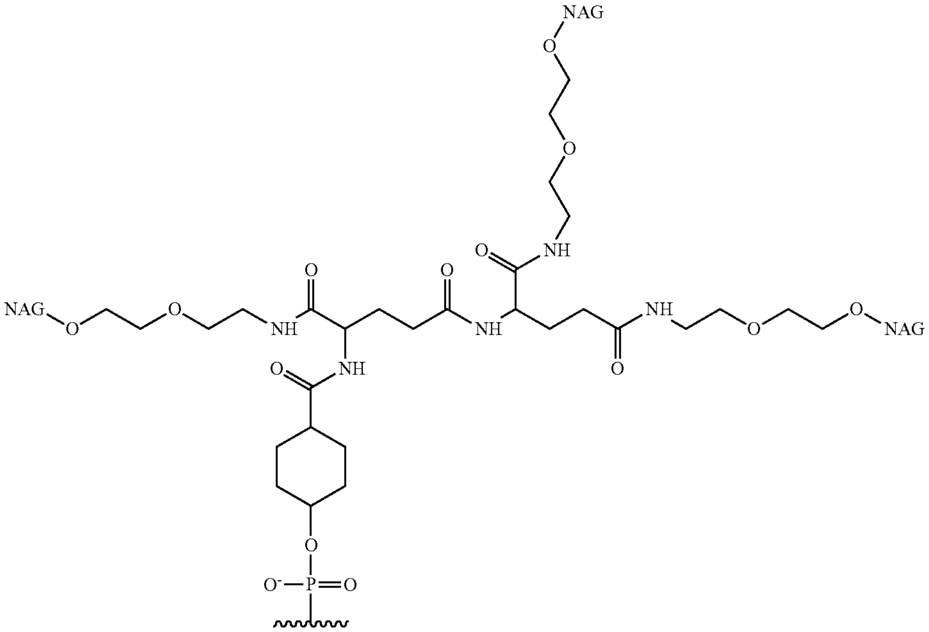 |
| (NAG29) |

TABLE 4-continued
| Structures representing various modified nucleotides, targeting groups, linking groups, and combinations of targeting groups and linking groups. |
|---|
| 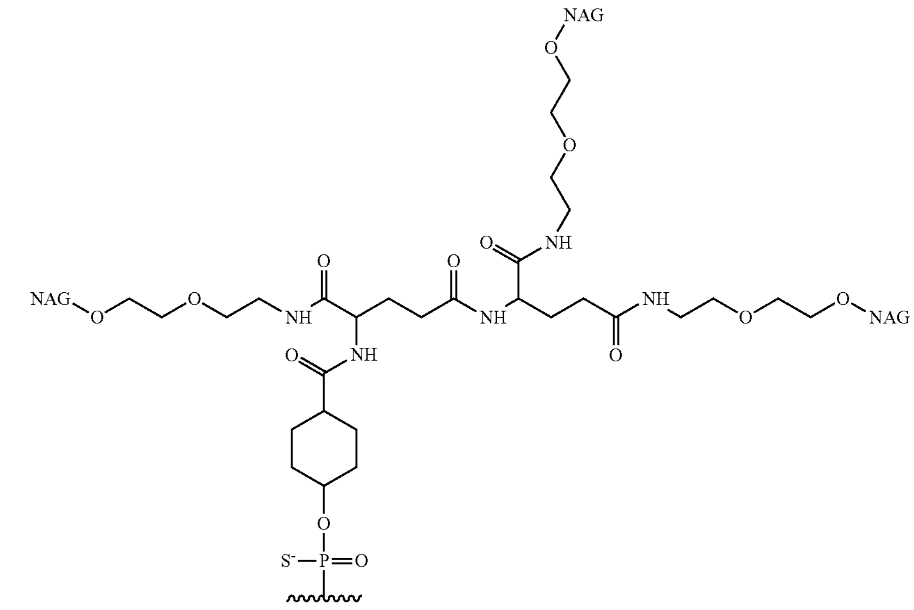 |
| (NAG29)s |
| 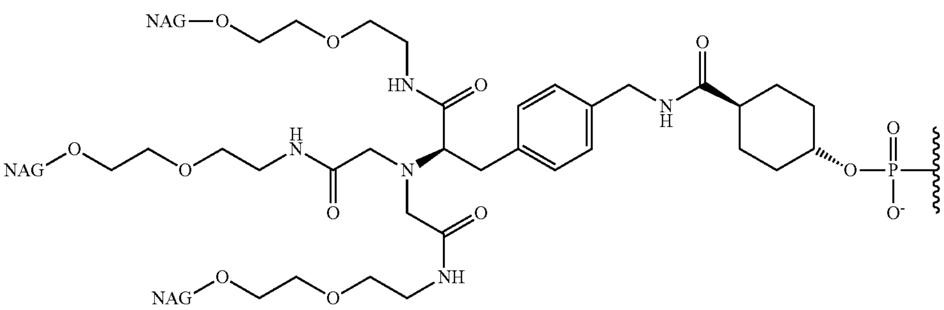 |
| (NAG30) |
| 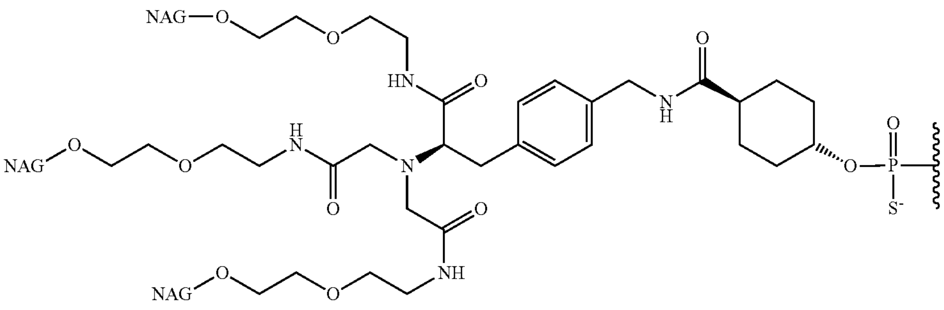 |
| (NAG30)s |

TABLE 4-continued
Structures representing various modified nucleotides, targeting groups, linking groups, and combinations of targeting groups and linking groups.
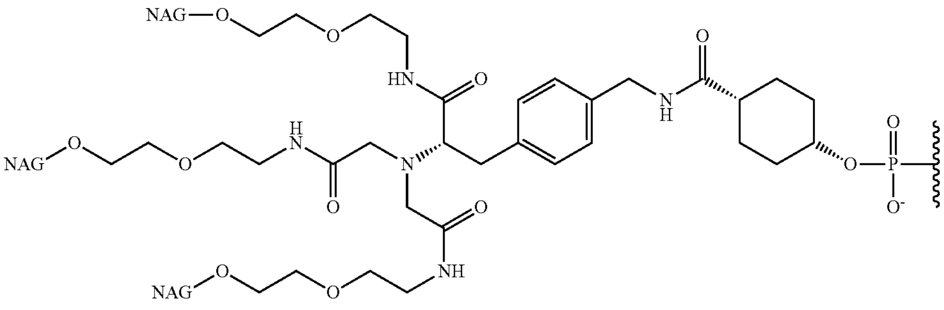
(NAG31)
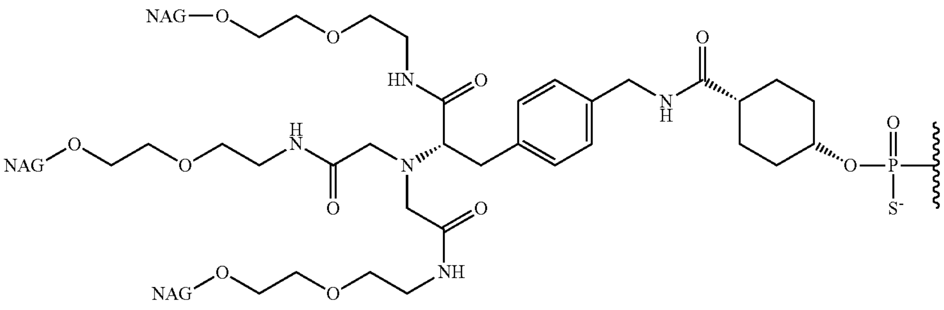
(NAG31)s
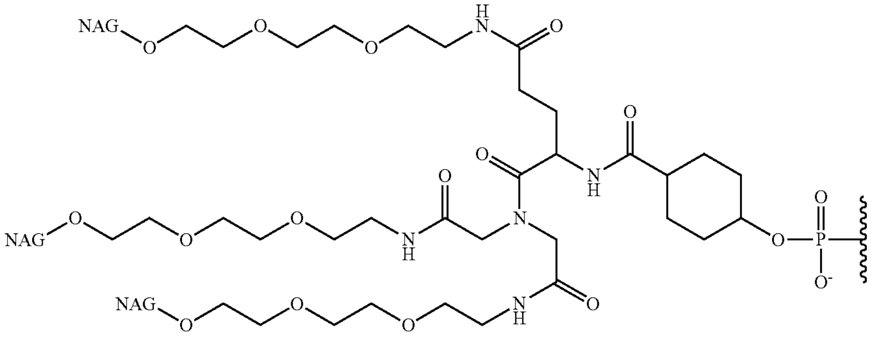
(NAG32)
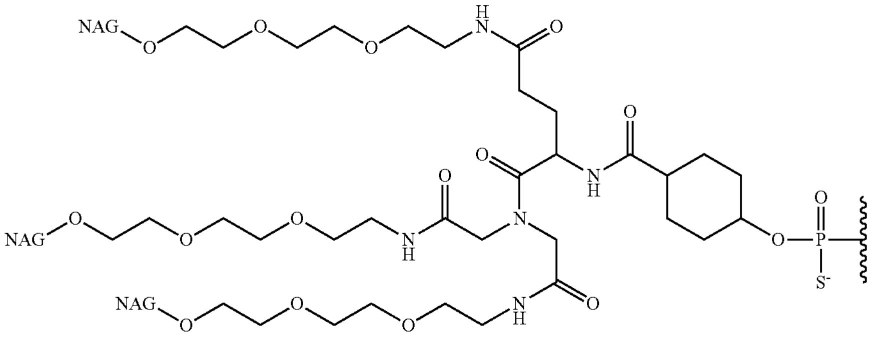
(NAG32)s TABLE 4-continued
Structures representing various modified nucleotides, targeting groups, linking groups, and combinations of targeting groups and linking groups.
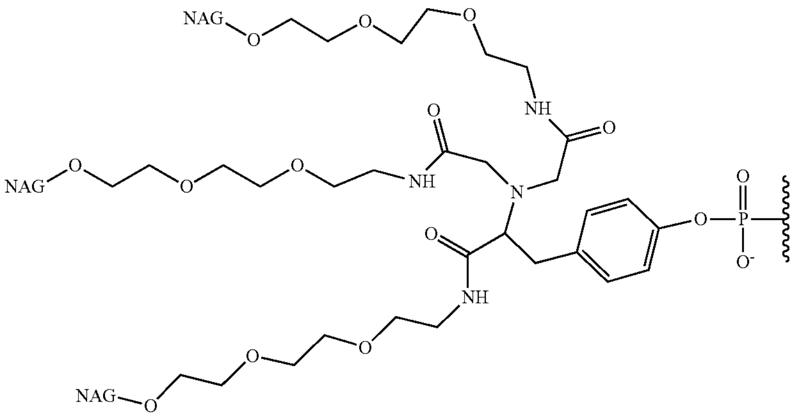
(NAG33)
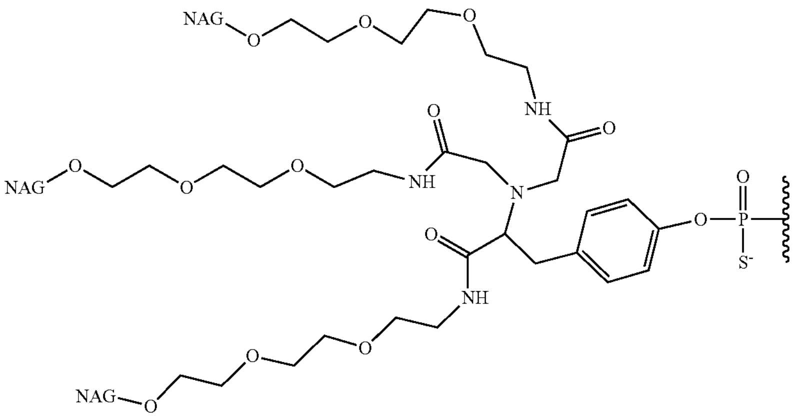
(NAG33)s
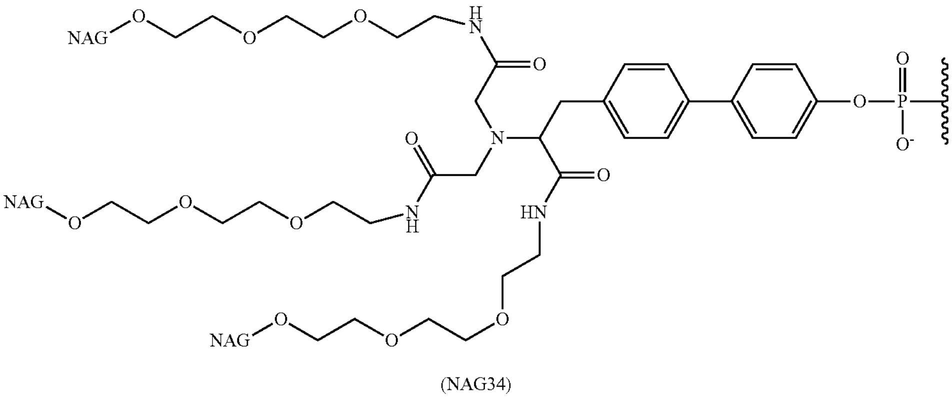
(NAG34)

TABLE 4-continued
| Structures representing various modified nucleotides, targeting groups, linking groups, and combinations of targeting groups and linking groups. |
| --- |
| 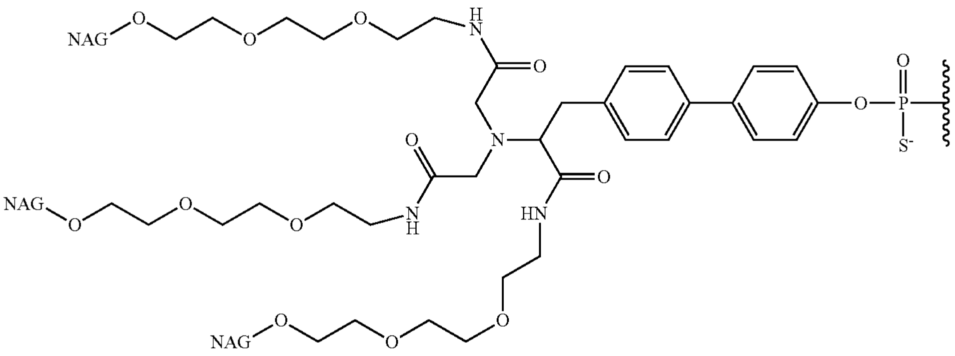 |
| (NAG34)s |
| 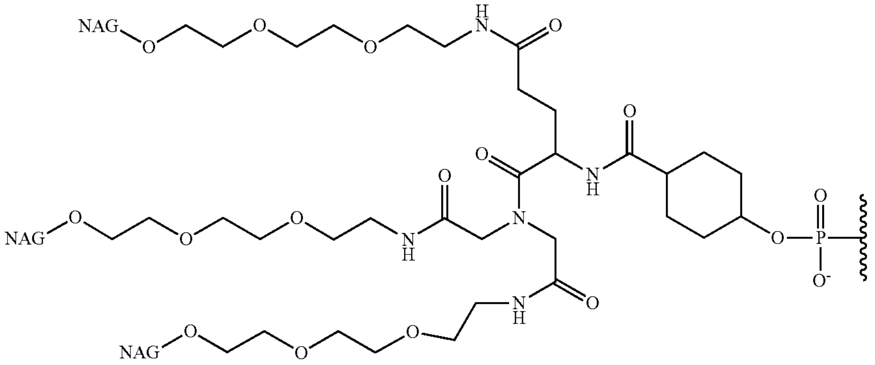 |
| (NAG35) |
| 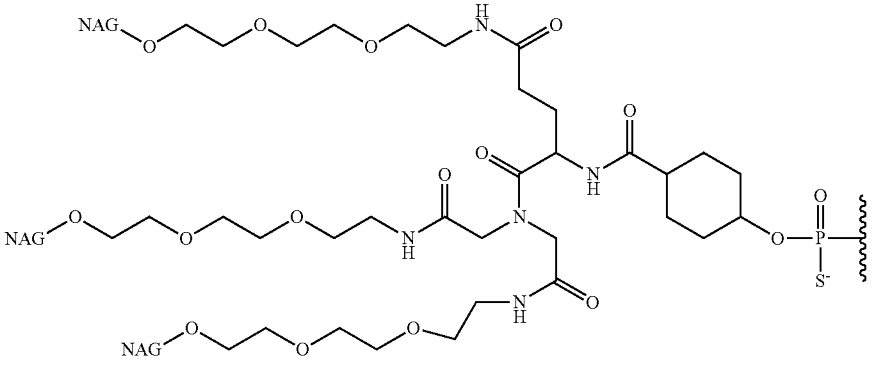 |
| (NAG35)s |

TABLE 4-continued
| Structures representing various modified nucleotides, targeting groups, linking groups, and combinations of targeting groups and linking groups. |
|---|
| 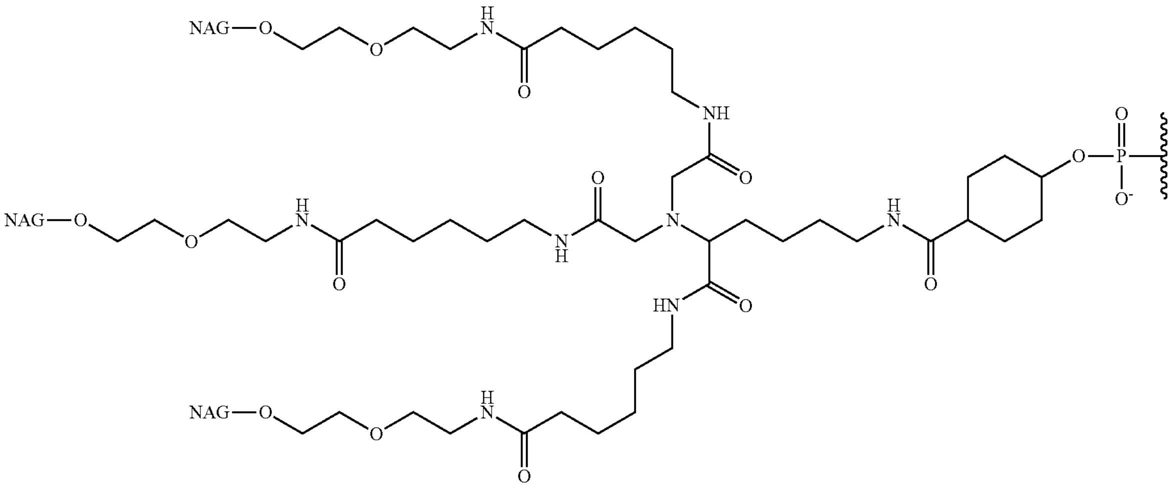 |
| (NAG36) |
| 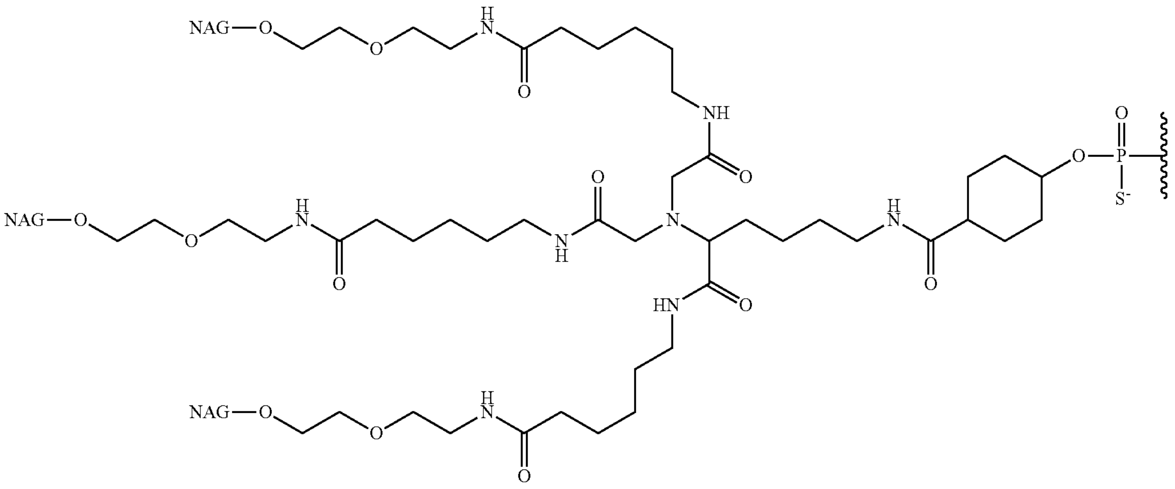 |
| (NAG36)s |
| 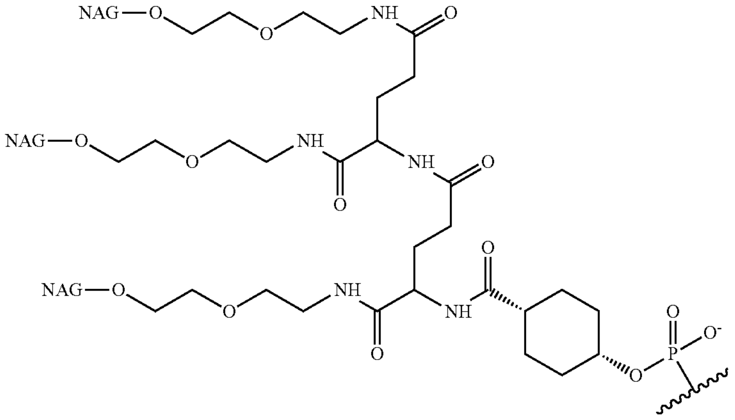 |
| (NAG37) |

TABLE 4-continued
| Structures representing various modified nucleotides, targeting groups, linking groups, and combinations of targeting groups and linking groups. |
| --- |
| 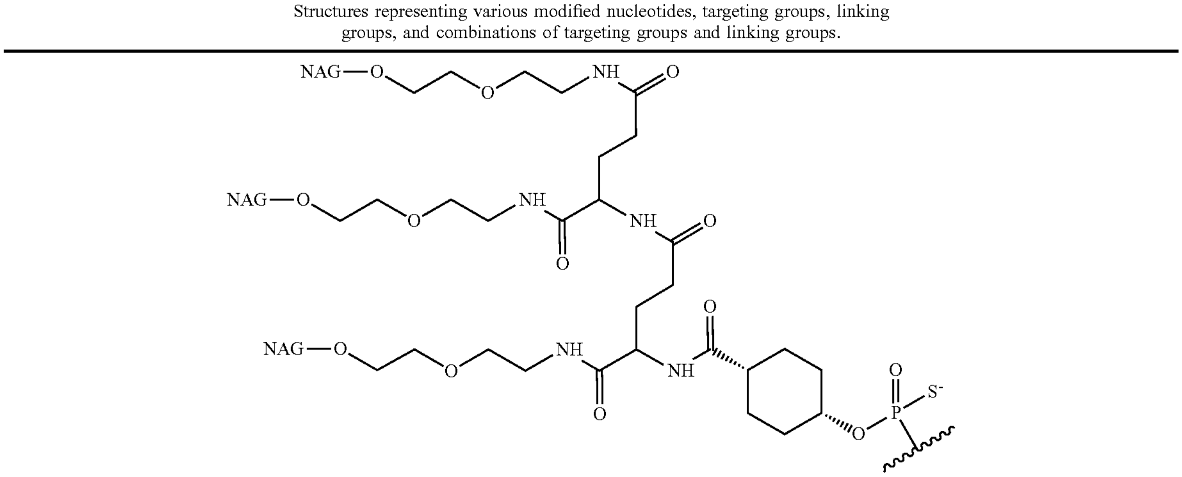 |
| (NAG37)s |
| 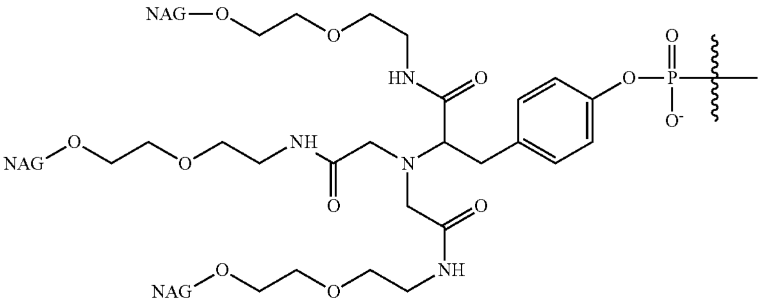 |
| (NAG 38) |
| 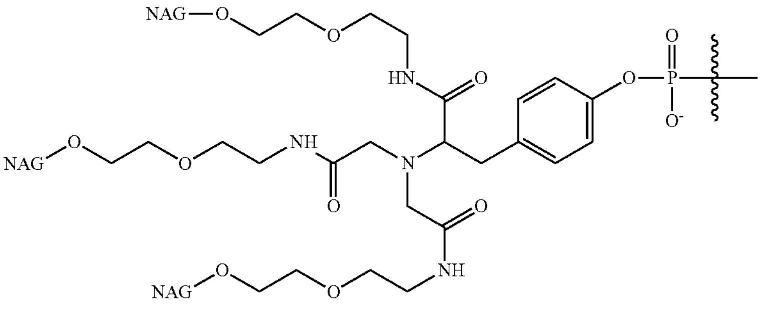 |
| (NAG 38)s |
| 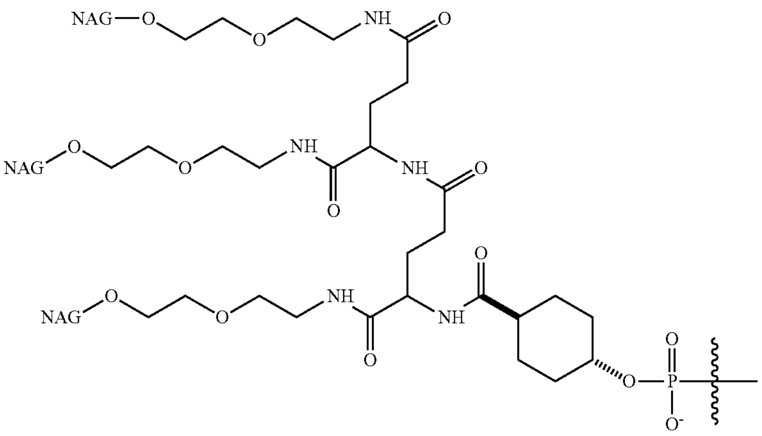 |

TABLE 4-continued
| Structures representing various modified nucleotides, targeting groups, linking groups, and combinations of targeting groups and linking groups. |
|---|
(NAG39)
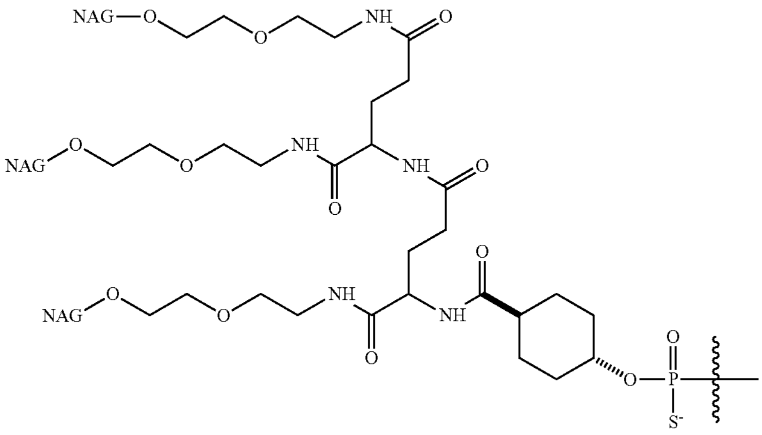
(NAG39)s
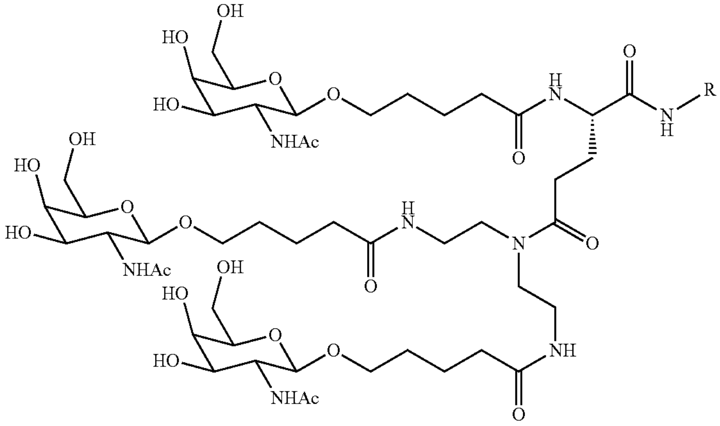
Formula I
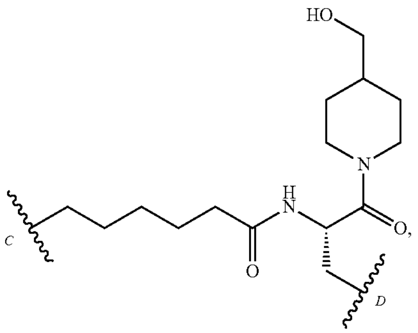
Formula III
where R is an oligonucleotide conjugated to Formula I via
Formula III
Formula IV TABLE 4-continued
Structures representing various modified nucleotides, targeting groups, linking groups, and combinations of targeting groups and linking groups.
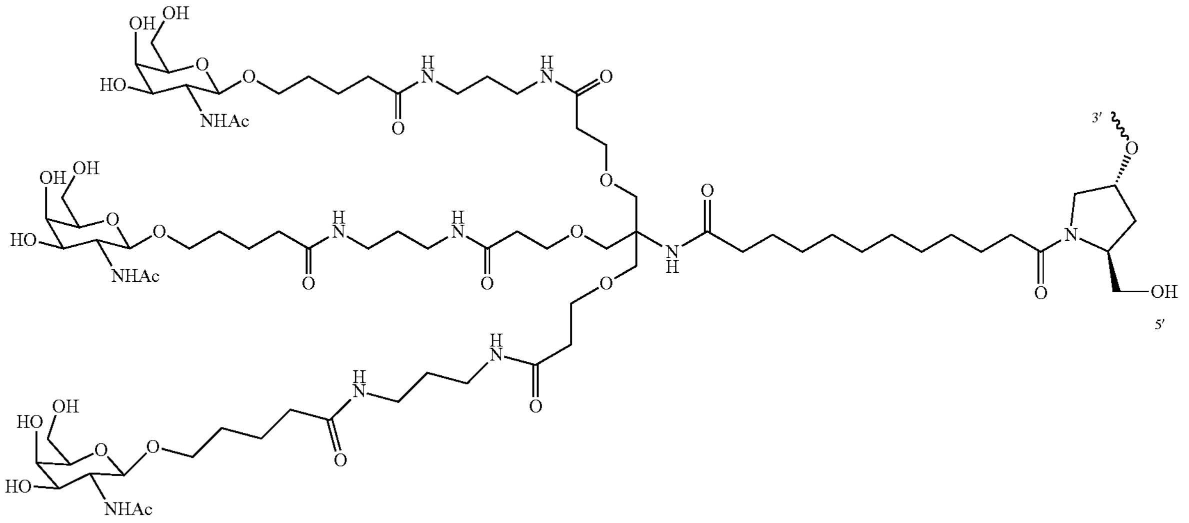
Formula V'
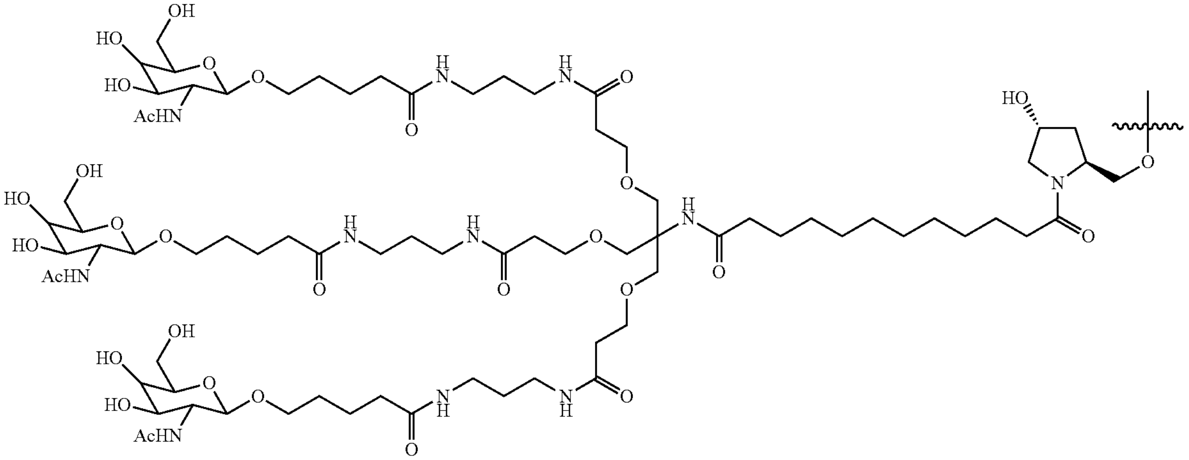 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]
Formula V
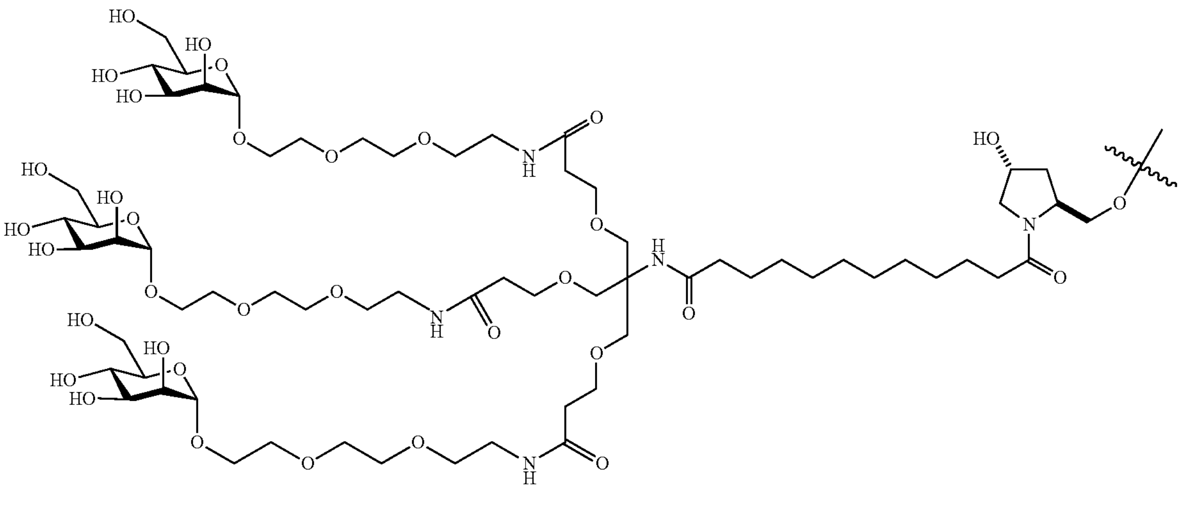
Formula VI Formula V' is a precursor of the Formula V as it may exist before it is conjugated to the RNAi agent. In some implementations of making a GalNAc-RNAi conjugate, Formula V' is bound, e.g., to a support at the squiggle sign. Then 3' phosphate of a nucleotide is reacted with the methoxy off the pyrrolidine ring, and then additional nucleotides are added, growing a strand 3'→5'. Finally, the GalNAc-RNAi conjugate is hydrolyzed at the site of the squiggle sign of Formula V', cleaving it off the support, resulting a GalNAc-RNAi conjugate that includes the GalNAc of Formula V.

In some embodiments, the modified sense strand of the RNAi agent is conjugated to the targeting ligand and linking group of Formula IV.

In some embodiments, the RNAi agent has a modified sense strand of SEQ ID NO: 604 conjugated to Formula IV at 3' end. In some embodiments, the RNAi agent has a modified antisense strand of SEQ ID NO: 531. In some embodiments, the RNAi agent has a modified sense strand of SEQ ID NO: 604 conjugated to Formula IV at 3' end and a modified antisense strand of SEQ ID NO: 531.

In some embodiments, the RNAi agent has a modified sense strand of SEQ ID NO: 605 conjugated to Formula IV at 3' end. In some embodiments, the RNAi agent has a modified antisense strand of SEQ ID NO: 532. In some embodiments, the RNAi agent has a modified sense strand of SEQ ID NO: 605 conjugated to Formula IV at 3' end and a modified antisense strand of SEQ ID NO: 532.

In some embodiments, the RNAi agent has a modified sense strand of SEQ ID NO: 606 conjugated to Formula IV at 3' end. In some embodiments, the RNAi agent has a modified antisense strand of SEQ ID NO: 533. In some embodiments, the RNAi agent has a modified sense strand of SEQ ID NO: 606 conjugated to Formula IV at 3' end and a modified antisense strand of SEQ ID NO: 533.

In some embodiments, the RNAi agent has a modified sense strand of SEQ ID NO: 607 conjugated to Formula IV at 3' end. In some embodiments, the RNAi agent has a modified antisense strand of SEQ ID NO: 534. In some embodiments, the RNAi agent has a modified sense strand of SEQ ID NO: 607 conjugated to Formula IV at 3' end and a modified antisense strand of SEQ ID NO: 534.

In some embodiments, the RNAi agent has a modified sense strand of SEQ ID NO: 608 conjugated to Formula IV at 3' end. In some embodiments, the RNAi agent has a modified antisense strand of SEQ ID NO: 535. In some embodiments, the RNAi agent has a modified sense strand of SEQ ID NO: 608 conjugated to Formula IV at 3' end and a modified antisense strand of SEQ ID NO: 535.

In some embodiments, the RNAi agent has a modified sense strand of SEQ ID NO: 609 conjugated to Formula IV at 3' end. In some embodiments, the RNAi agent has a modified antisense strand of SEQ ID NO: 536. In some embodiments, the RNAi agent has a modified sense strand of SEQ ID NO: 609 conjugated to Formula IV at 3' end and a modified antisense strand of SEQ ID NO: 536.

In some embodiments, the RNAi agent has a modified sense strand of SEQ ID NO: 610 conjugated to Formula IV at 3' end. In some embodiments, the RNAi agent has a modified antisense strand of SEQ ID NO: 537. In some embodiments, the RNAi agent has a modified sense strand of SEQ ID NO: 610 conjugated to Formula IV at 3' end and a modified antisense strand of SEQ ID NO: 537.

In some embodiments, the RNAi agent has a modified sense strand of SEQ ID NO: 611 conjugated to Formula IV at 3' end. In some embodiments, the RNAi agent has a modified antisense strand of SEQ ID NO: 538. In some embodiments, the RNAi agent has a modified sense strand of SEQ ID NO: 611 conjugated to Formula IV at 3' end and a modified antisense strand of SEQ ID NO: 538.

In some embodiments, the RNAi agent has a modified sense strand of SEQ ID NO: 612 conjugated to Formula IV at 3' end. In some embodiments, the RNAi agent has a modified antisense strand of SEQ ID NO: 539. In some embodiments, the RNAi agent has a modified sense strand of SEQ ID NO: 612 conjugated to Formula IV at 3' end and a modified antisense strand of SEQ ID NO: 539.

In some embodiments, the RNAi agent has a modified sense strand of SEQ ID NO: 613 conjugated to Formula IV at 3' end. In some embodiments, the RNAi agent has a modified antisense strand of SEQ ID NO: 540. In some embodiments, the RNAi agent has a modified sense strand of SEQ ID NO: 613 conjugated to Formula IV at 3' end and a modified antisense strand of SEQ ID NO: 540.

In some embodiments, the RNAi agent has a modified sense strand of SEQ ID NO: 614 conjugated to Formula IV at 3' end. In some embodiments, the RNAi agent has a modified antisense strand of SEQ ID NO: 541. In some embodiments, the RNAi agent has a modified sense strand of SEQ ID NO: 614 conjugated to Formula IV at 3' end and a modified antisense strand of SEQ ID NO: 541.

In some embodiments, the RNAi agent has a modified sense strand of SEQ ID NO: 615 conjugated to Formula IV at 3' end. In some embodiments, the RNAi agent has a modified antisense strand of SEQ ID NO: 542. In some embodiments, the RNAi agent has a modified sense strand of SEQ ID NO: 615 conjugated to Formula IV at 3' end and a modified antisense strand of SEQ ID NO: 542.

In some embodiments, the RNAi agent has a modified sense strand of SEQ ID NO: 616 conjugated to Formula IV at 3' end. In some embodiments, the RNAi agent has a modified antisense strand of SEQ ID NO: 543. In some embodiments, the RNAi agent has a modified sense strand of SEQ ID NO: 616 conjugated to Formula IV at 3' end and a modified antisense strand of SEQ ID NO: 543.

In some embodiments, the RNAi agent has a modified sense strand of SEQ ID NO: 617 conjugated to Formula IV at 3' end. In some embodiments, the RNAi agent has a modified antisense strand of SEQ ID NO: 544. In some embodiments, the RNAi agent has a modified sense strand of SEQ ID NO: 617 conjugated to Formula IV at 3' end and a modified antisense strand of SEQ ID NO: 544.

In some embodiments, the RNAi agent has a modified sense strand of SEQ ID NO: 618 conjugated to Formula IV at 3' end. In some embodiments, the RNAi agent has a modified antisense strand of SEQ ID NO: 545. In some embodiments, the RNAi agent has a modified sense strand of SEQ ID NO: 618 conjugated to Formula IV at 3' end and a modified antisense strand of SEQ ID NO: 545.

In some embodiments, the RNAi agent has a modified sense strand of SEQ ID NO: 619 conjugated to Formula IV at 3' end. In some embodiments, the RNAi agent has a modified antisense strand of SEQ ID NO: 546. In some embodiments, the RNAi agent has a modified sense strand of SEQ ID NO: 619 conjugated to Formula IV at 3' end and a modified antisense strand of SEQ ID NO: 546.

In some embodiments, the RNAi agent has a modified sense strand of SEQ ID NO: 620 conjugated to Formula IV at 3' end. In some embodiments, the RNAi agent has a modified antisense strand of SEQ ID NO: 547. In some embodiments, the RNAi agent has a modified sense strand of SEQ ID NO: 620 conjugated to Formula IV at 3' end and a modified antisense strand of SEQ ID NO: 547.

In some embodiments, the RNAi agent has a modified sense strand of SEQ ID NO: 621 conjugated to Formula IV at 3' end. In some embodiments, the RNAi agent has a modified antisense strand of SEQ ID NO: 548. In some embodiments, the RNAi agent has a modified sense strand of SEQ ID NO: 621 conjugated to Formula IV at 3' end and a modified antisense strand of SEQ ID NO: 548.

In some embodiments, the RNAi agent has a modified sense strand of SEQ ID NO: 622 conjugated to Formula IV at 3' end. In some embodiments, the RNAi agent has a modified antisense strand of SEQ ID NO: 549. In some embodiments, the RNAi agent has a modified sense strand of SEQ ID NO: 622 conjugated to Formula IV at 3' end and a modified antisense strand of SEQ ID NO: 549.

In some embodiments, the RNAi agent has a modified sense strand of SEQ ID NO: 623 conjugated to Formula IV at 3' end. In some embodiments, the RNAi agent has a modified antisense strand of SEQ ID NO: 550. In some embodiments, the RNAi agent has a modified sense strand of SEQ ID NO: 623 conjugated to Formula IV at 3' end and a modified antisense strand of SEQ ID NO: 550.

In some embodiments, the RNAi agent has a modified sense strand of SEQ ID NO: 624 conjugated to Formula IV at 3' end. In some embodiments, the RNAi agent has a modified antisense strand of SEQ ID NO: 551. In some embodiments, the RNAi agent has a modified sense strand of SEQ ID NO: 624 conjugated to Formula IV at 3' end and a modified antisense strand of SEQ ID NO: 551.

In some embodiments, the RNAi agent has a modified sense strand of SEQ ID NO: 625 conjugated to Formula IV at 3' end. In some embodiments, the RNAi agent has a modified antisense strand of SEQ ID NO: 552. In some embodiments, the RNAi agent has a modified sense strand of SEQ ID NO: 625 conjugated to Formula IV at 3' end and a modified antisense strand of SEQ ID NO: 552.

In some embodiments, the RNAi agent has a modified sense strand of SEQ ID NO: 626 conjugated to Formula IV at 3' end. In some embodiments, the RNAi agent has a modified antisense strand of SEQ ID NO: 553. In some embodiments, the RNAi agent has a modified sense strand of SEQ ID NO: 626 conjugated to Formula IV at 3' end and a modified antisense strand of SEQ ID NO: 553.

In some embodiments, the RNAi agent has a modified sense strand of SEQ ID NO: 627 conjugated to Formula IV at 3' end. In some embodiments, the RNAi agent has a modified antisense strand of SEQ ID NO: 554. In some embodiments, the RNAi agent has a modified sense strand of SEQ ID NO: 627 conjugated to Formula IV at 3' end and a modified antisense strand of SEQ ID NO: 554.

In some embodiments, the RNAi agent has a modified sense strand of SEQ ID NO: 628 conjugated to Formula IV at 3' end. In some embodiments, the RNAi agent has a modified antisense strand of SEQ ID NO: 555. In some embodiments, the RNAi agent has a modified sense strand of SEQ ID NO: 628 conjugated to Formula IV at 3' end and a modified antisense strand of SEQ ID NO: 555.

In some embodiments, the RNAi agent has a modified sense strand of SEQ ID NO: 629 conjugated to Formula IV at 3' end. In some embodiments, the RNAi agent has a modified antisense strand of SEQ ID NO: 5526. In some embodiments, the RNAi agent has a modified sense strand of SEQ ID NO: 629 conjugated to Formula IV at 3' end and a modified antisense strand of SEQ ID NO: 556.

In some embodiments, the RNAi agent has a modified sense strand of SEQ ID NO: 630 conjugated to Formula IV at 3' end. In some embodiments, the RNAi agent has a modified antisense strand of SEQ ID NO: 557. In some embodiments, the RNAi agent has a modified sense strand of SEQ ID NO: 630 conjugated to Formula IV at 3' end and a modified antisense strand of SEQ ID NO: 557.

In some embodiments, the RNAi agent has a modified sense strand of SEQ ID NO: 631 conjugated to Formula IV at 3' end. In some embodiments, the RNAi agent has a modified antisense strand of SEQ ID NO: 558. In some embodiments, the RNAi agent has a modified sense strand of SEQ ID NO: 631 conjugated to Formula IV at 3' end and a modified antisense strand of SEQ ID NO: 558.

In some embodiments, the RNAi agent has a modified sense strand of SEQ ID NO: 632 conjugated to Formula IV at 3' end. In some embodiments, the RNAi agent has a modified antisense strand of SEQ ID NO: 559. In some embodiments, the RNAi agent has a modified sense strand of SEQ ID NO: 632 conjugated to Formula IV at 3' end and a modified antisense strand of SEQ ID NO: 559.

In some embodiments, the RNAi agent has a modified sense strand of SEQ ID NO: 633 conjugated to Formula IV at 3' end. In some embodiments, the RNAi agent has a modified antisense strand of SEQ ID NO: 560. In some embodiments, the RNAi agent has a modified sense strand of SEQ ID NO: 633 conjugated to Formula IV at 3' end and a modified antisense strand of SEQ ID NO: 560.

In some embodiments, the RNAi agent has a modified sense strand of SEQ ID NO: 634 conjugated to Formula IV at 3' end. In some embodiments, the RNAi agent has a modified antisense strand of SEQ ID NO: 561. In some embodiments, the RNAi agent has a modified sense strand of SEQ ID NO: 634 conjugated to Formula IV at 3' end and a modified antisense strand of SEQ ID NO: 561.

In some embodiments, the RNAi agent has a modified sense strand of SEQ ID NO: 635 conjugated to Formula IV at 3' end. In some embodiments, the RNAi agent has a modified antisense strand of SEQ ID NO: 562. In some embodiments, the RNAi agent has a modified sense strand of SEQ ID NO: 635 conjugated to Formula IV at 3' end and a modified antisense strand of SEQ ID NO: 562.

In some embodiments, the RNAi agent has a modified sense strand of SEQ ID NO: 636 conjugated to Formula IV at 3' end. In some embodiments, the RNAi agent has a modified antisense strand of SEQ ID NO: 563. In some embodiments, the RNAi agent has a modified sense strand of SEQ ID NO: 636 conjugated to Formula IV at 3' end and a modified antisense strand of SEQ ID NO: 563.

In some embodiments, the RNAi agent has a modified sense strand of SEQ ID NO: 637 conjugated to Formula IV at 3' end. In some embodiments, the RNAi agent has a modified antisense strand of SEQ ID NO: 564. In some embodiments, the RNAi agent has a modified sense strand of SEQ ID NO: 637 conjugated to Formula IV at 3' end and a modified antisense strand of SEQ ID NO: 564.

In some embodiments, the RNAi agent has a modified sense strand of SEQ ID NO: 638 conjugated to Formula IV at 3' end. In some embodiments, the RNAi agent has a modified antisense strand of SEQ ID NO: 565. In some embodiments, the RNAi agent has a modified sense strand of SEQ ID NO: 638 conjugated to Formula IV at 3' end and a modified antisense strand of SEQ ID NO: 565.

In some embodiments, the RNAi agent has a modified sense strand of SEQ ID NO: 639 conjugated to Formula IV at 3' end. In some embodiments, the RNAi agent has a modified antisense strand of SEQ ID NO: 566. In some embodiments, the RNAi agent has a modified sense strand of SEQ ID NO: 639 conjugated to Formula IV at 3' end and a modified antisense strand of SEQ ID NO: 566.

In some embodiments, the RNAi agent has a modified sense strand of SEQ ID NO: 640 conjugated to Formula IV at 3' end. In some embodiments, the RNAi agent has a modified antisense strand of SEQ ID NO: 567. In some embodiments, the RNAi agent has a modified sense strand of SEQ ID NO: 640 conjugated to Formula IV at 3' end and a modified antisense strand of SEQ ID NO: 567.

In some embodiments, the RNAi agent has a modified sense strand of SEQ ID NO: 641 conjugated to Formula IV at 3' end. In some embodiments, the RNAi agent has a modified antisense strand of SEQ ID NO: 568. In some embodiments, the RNAi agent has a modified sense strand of SEQ ID NO: 641 conjugated to Formula IV at 3' end and a modified antisense strand of SEQ ID NO: 568.

In some embodiments, the RNAi agent has a modified sense strand of SEQ ID NO: 642 conjugated to Formula IV at 3' end. In some embodiments, the RNAi agent has a modified antisense strand of SEQ ID NO: 569. In some embodiments, the RNAi agent has a modified sense strand of SEQ ID NO: 642 conjugated to Formula IV at 3' end and a modified antisense strand of SEQ ID NO: 569.

In some embodiments, the RNAi agent has a modified sense strand of SEQ ID NO: 643 conjugated to Formula IV at 3' end. In some embodiments, the RNAi agent has a modified antisense strand of SEQ ID NO: 570. In some embodiments, the RNAi agent has a modified sense strand of SEQ ID NO: 643 conjugated to Formula IV at 3' end and a modified antisense strand of SEQ ID NO: 570.

In some embodiments, the RNAi agent has a modified sense strand of SEQ ID NO: 644 conjugated to Formula IV at 3' end. In some embodiments, the RNAi agent has a modified antisense strand of SEQ ID NO: 571. In some embodiments, the RNAi agent has a modified sense strand of SEQ ID NO: 644 conjugated to Formula IV at 3' end and a modified antisense strand of SEQ ID NO: 571.

In some embodiments, the RNAi agent has a modified sense strand of SEQ ID NO: 645 conjugated to Formula IV at 3' end. In some embodiments, the RNAi agent has a modified antisense strand of SEQ ID NO: 572. In some embodiments, the RNAi agent has a modified sense strand of SEQ ID NO: 645 conjugated to Formula IV at 3' end and a modified antisense strand of SEQ ID NO: 572.

In some embodiments, the RNAi agent has a modified sense strand of SEQ ID NO: 646 conjugated to Formula IV at 3' end. In some embodiments, the RNAi agent has a modified antisense strand of SEQ ID NO: 573. In some embodiments, the RNAi agent has a modified sense strand of SEQ ID NO: 646 conjugated to Formula IV at 3' end and a modified antisense strand of SEQ ID NO: 573.

In some embodiments, the RNAi agent has a modified sense strand of SEQ ID NO: 647 conjugated to Formula IV at 3' end. In some embodiments, the RNAi agent has a modified antisense strand of SEQ ID NO: 574. In some embodiments, the RNAi agent has a modified sense strand of SEQ ID NO: 647 conjugated to Formula IV at 3' end and a modified antisense strand of SEQ ID NO: 574.

In some embodiments, the RNAi agent has a modified sense strand of SEQ ID NO: 648 conjugated to Formula IV at 3' end. In some embodiments, the RNAi agent has a modified antisense strand of SEQ ID NO: 575. In some embodiments, the RNAi agent has a modified sense strand of SEQ ID NO: 648 conjugated to Formula IV at 3' end and a modified antisense strand of SEQ ID NO: 575.

In some embodiments, the RNAi agent has a modified sense strand of SEQ ID NO: 649 conjugated to Formula IV at 3' end. In some embodiments, the RNAi agent has a modified antisense strand of SEQ ID NO: 576. In some embodiments, the RNAi agent has a modified sense strand of SEQ ID NO: 649 conjugated to Formula IV at 3' end and a modified antisense strand of SEQ ID NO: 576.

In some embodiments, the RNAi agent has a modified sense strand of SEQ ID NO: 650 conjugated to Formula IV at 3' end. In some embodiments, the RNAi agent has a modified antisense strand of SEQ ID NO: 577. In some embodiments, the RNAi agent has a modified sense strand of SEQ ID NO: 650 conjugated to Formula IV at 3' end and a modified antisense strand of SEQ ID NO: 577.

In some embodiments, the RNAi agent has a modified sense strand of SEQ ID NO: 651 conjugated to Formula IV at 3' end. In some embodiments, the RNAi agent has a modified antisense strand of SEQ ID NO: 578. In some embodiments, the RNAi agent has a modified sense strand of SEQ ID NO: 651 conjugated to Formula IV at 3' end and a modified antisense strand of SEQ ID NO: 578.

In some embodiments, the RNAi agent has a modified sense strand of SEQ ID NO: 652 conjugated to Formula IV at 3' end. In some embodiments, the RNAi agent has a modified antisense strand of SEQ ID NO: 579. In some embodiments, the RNAi agent has a modified sense strand of SEQ ID NO: 652 conjugated to Formula IV at 3' end and a modified antisense strand of SEQ ID NO: 579.

In some embodiments, the RNAi agent has a modified sense strand of SEQ ID NO: 653 conjugated to Formula IV at 3' end. In some embodiments, the RNAi agent has a modified antisense strand of SEQ ID NO: 580. In some embodiments, the RNAi agent has a modified sense strand of SEQ ID NO: 653 conjugated to Formula IV at 3' end and a modified antisense strand of SEQ ID NO: 580.

In some embodiments, the RNAi agent has a modified sense strand of SEQ ID NO: 654 conjugated to Formula IV at 3' end. In some embodiments, the RNAi agent has a modified antisense strand of SEQ ID NO: 581. In some embodiments, the RNAi agent has a modified sense strand of SEQ ID NO: 654 conjugated to Formula IV at 3' end and a modified antisense strand of SEQ ID NO: 581.

In some embodiments, the RNAi agent has a modified sense strand of SEQ ID NO: 655 conjugated to Formula IV at 3' end. In some embodiments, the RNAi agent has a modified antisense strand of SEQ ID NO: 581. In some embodiments, the RNAi agent has a modified sense strand of SEQ ID NO: 655 conjugated to Formula IV at 3' end and a modified antisense strand of SEQ ID NO: 581.

In some embodiments, the RNAi agent has a modified sense strand of SEQ ID NO: 656 conjugated to Formula IV at 3' end. In some embodiments, the RNAi agent has a modified antisense strand of SEQ ID NO: 583. In some embodiments, the RNAi agent has a modified sense strand of SEQ ID NO: 656 conjugated to Formula IV at 3' end and a modified antisense strand of SEQ ID NO: 583.

In some embodiments, the RNAi agent has a modified sense strand of SEQ ID NO: 657 conjugated to Formula IV at 3' end. In some embodiments, the RNAi agent has a modified antisense strand of SEQ ID NO: 584. In some embodiments, the RNAi agent has a modified sense strand of SEQ ID NO: 657 conjugated to Formula IV at 3' end and a modified antisense strand of SEQ ID NO: 584.

In some embodiments, the RNAi agent has a modified sense strand of SEQ ID NO: 658 conjugated to Formula IV at 3' end. In some embodiments, the RNAi agent has a modified antisense strand of SEQ ID NO: 585. In some embodiments, the RNAi agent has a modified sense strand of SEQ ID NO: 658 conjugated to Formula IV at 3' end and a modified antisense strand of SEQ ID NO: 585.

In some embodiments, the RNAi agent has a modified sense strand of SEQ ID NO: 659 conjugated to Formula IV at 3' end. In some embodiments, the RNAi agent has a modified antisense strand of SEQ ID NO: 586. In some embodiments, the RNAi agent has a modified sense strand of SEQ ID NO: 659 conjugated to Formula IV at 3' end and a modified antisense strand of SEQ ID NO: 586.

In some embodiments, the RNAi agent has a modified sense strand of SEQ ID NO: 660 conjugated to Formula IV at 3' end. In some embodiments, the RNAi agent has a modified antisense strand of SEQ ID NO: 587. In some embodiments, the RNAi agent has a modified sense strand of SEQ ID NO: 660 conjugated to Formula IV at 3' end and a modified antisense strand of SEQ ID NO: 587.

In some embodiments, the RNAi agent has a modified sense strand of SEQ ID NO: 661 conjugated to Formula IV at 3' end. In some embodiments, the RNAi agent has a modified antisense strand of SEQ ID NO: 588. In some embodiments, the RNAi agent has a modified sense strand of SEQ ID NO: 661 conjugated to Formula IV at 3' end and a modified antisense strand of SEQ ID NO: 588.

In some embodiments, the RNAi agent has a modified sense strand of SEQ ID NO: 662 conjugated to Formula IV at 3' end. In some embodiments, the RNAi agent has a modified antisense strand of SEQ ID NO: 589. In some embodiments, the RNAi agent has a modified sense strand of SEQ ID NO: 662 conjugated to Formula IV at 3' end and a modified antisense strand of SEQ ID NO: 589.

In some embodiments, the RNAi agent has a modified sense strand of SEQ ID NO: 663 conjugated to Formula IV at 3' end. In some embodiments, the RNAi agent has a modified antisense strand of SEQ ID NO: 590. In some embodiments, the RNAi agent has a modified sense strand of SEQ ID NO: 663 conjugated to Formula IV at 3' end and a modified antisense strand of SEQ ID NO: 590.

In some embodiments, the RNAi agent has a modified sense strand of SEQ ID NO: 664 conjugated to Formula IV at 3' end. In some embodiments, the RNAi agent has a modified antisense strand of SEQ ID NO: 591. In some embodiments, the RNAi agent has a modified sense strand of SEQ ID NO: 664 conjugated to Formula IV at 3' end and a modified antisense strand of SEQ ID NO: 591.

In some embodiments, the RNAi agent has a modified sense strand of SEQ ID NO: 665 conjugated to Formula IV at 3' end. In some embodiments, the RNAi agent has a modified antisense strand of SEQ ID NO: 592. In some embodiments, the RNAi agent has a modified sense strand of SEQ ID NO: 665 conjugated to Formula IV at 3' end and a modified antisense strand of SEQ ID NO: 592.

In some embodiments, the RNAi agent has a modified sense strand of SEQ ID NO: 666 conjugated to Formula IV at 3' end. In some embodiments, the RNAi agent has a modified antisense strand of SEQ ID NO: 593. In some embodiments, the RNAi agent has a modified sense strand of SEQ ID NO: 666 conjugated to Formula IV at 3' end and a modified antisense strand of SEQ ID NO: 593.

In some embodiments, the RNAi agent has a modified sense strand of SEQ ID NO: 667 conjugated to Formula IV at 3' end. In some embodiments, the RNAi agent has a modified antisense strand of SEQ ID NO: 594. In some embodiments, the RNAi agent has a modified sense strand of SEQ ID NO: 667 conjugated to Formula IV at 3' end and a modified antisense strand of SEQ ID NO: 594.

In some embodiments, the RNAi agent has a modified sense strand of SEQ ID NO: 668 conjugated to Formula IV at 3' end. In some embodiments, the RNAi agent has a modified antisense strand of SEQ ID NO: 595. In some embodiments, the RNAi agent has a modified sense strand of SEQ ID NO: 668 conjugated to Formula IV at 3' end and a modified antisense strand of SEQ ID NO: 595.

In some embodiments, the RNAi agent has a modified sense strand of SEQ ID NO: 669 conjugated to Formula IV at 3' end. In some embodiments, the RNAi agent has a modified antisense strand of SEQ ID NO: 596. In some embodiments, the RNAi agent has a modified sense strand of SEQ ID NO: 669 conjugated to Formula IV at 3' end and a modified antisense strand of SEQ ID NO: 596.

In some embodiments, the RNAi agent has a modified sense strand of SEQ ID NO: 670 conjugated to Formula IV at 3' end. In some embodiments, the RNAi agent has a modified antisense strand of SEQ ID NO: 597. In some embodiments, the RNAi agent has a modified sense strand of SEQ ID NO: 670 conjugated to Formula IV at 3' end and a modified antisense strand of SEQ ID NO: 597.

In some embodiments, the RNAi agent has a modified sense strand of SEQ ID NO: 671 conjugated to Formula IV at 3' end. In some embodiments, the RNAi agent has a modified antisense strand of SEQ ID NO: 598. In some embodiments, the RNAi agent has a modified sense strand of SEQ ID NO: 671 conjugated to Formula IV at 3' end and a modified antisense strand of SEQ ID NO: 598.

In some embodiments, the RNAi agent has a modified sense strand of SEQ ID NO: 672 conjugated to Formula IV at 3' end. In some embodiments, the RNAi agent has a modified antisense strand of SEQ ID NO: 599. In some embodiments, the RNAi agent has a modified sense strand of SEQ ID NO: 672 conjugated to Formula IV at 3' end and a modified antisense strand of SEQ ID NO: 599.

In some embodiments, the RNAi agent has a modified sense strand of SEQ ID NO: 673 conjugated to Formula IV at 3' end. In some embodiments, the RNAi agent has a modified antisense strand of SEQ ID NO: 600. In some embodiments, the RNAi agent has a modified sense strand of SEQ ID NO: 673 conjugated to Formula IV at 3' end and a modified antisense strand of SEQ ID NO: 600.

In some embodiments, the RNAi agent has a modified sense strand of SEQ ID NO: 674 conjugated to Formula IV at 3' end. In some embodiments, the RNAi agent has a modified antisense strand of SEQ ID NO: 601. In some embodiments, the RNAi agent has a modified sense strand of SEQ ID NO: 674 conjugated to Formula IV at 3' end and a modified antisense strand of SEQ ID NO: 601.

In some embodiments, the RNAi agent has a modified sense strand of SEQ ID NO: 675 conjugated to Formula IV at 3' end. In some embodiments, the RNAi agent has a modified antisense strand of SEQ ID NO: 602. In some embodiments, the RNAi agent has a modified sense strand of SEQ ID NO: 675 conjugated to Formula IV at 3' end and a modified antisense strand of SEQ ID NO: 602.

In some embodiments, the RNAi agent has a modified sense strand of SEQ ID NO: 676 conjugated to Formula IV at 3' end. In some embodiments, the RNAi agent has a modified antisense strand of SEQ ID NO: 603. In some embodiments, the RNAi agent has a modified sense strand of SEQ ID NO: 676 conjugated to Formula IV at 3' end and a modified antisense strand of SEQ ID NO: 603.

In some embodiments, the RNAi agent has a modified sense strand of SEQ ID NO: 713 conjugated to Formula IV at 3' end. In some embodiments, the RNAi agent has a modified antisense strand of SEQ ID NO: 701. In some embodiments, the RNAi agent has a modified sense strand of SEQ ID NO: 713 conjugated to Formula IV at 3' end and a modified antisense strand of SEQ ID NO: 701.

In some embodiments, the RNAi agent has a modified sense strand of SEQ ID NO: 714 conjugated to Formula IV at 3' end. In some embodiments, the RNAi agent has a modified antisense strand of SEQ ID NO: 702. In some embodiments, the RNAi agent has a modified sense strand of SEQ ID NO: 714 conjugated to Formula IV at 3' end and a modified antisense strand of SEQ ID NO: 702.

In some embodiments, the RNAi agent has a modified sense strand of SEQ ID NO: 715 conjugated to Formula IV at 3' end. In some embodiments, the RNAi agent has a modified antisense strand of SEQ ID NO: 703. In some embodiments, the RNAi agent has a modified sense strand of SEQ ID NO: 715 conjugated to Formula IV at 3' end and a modified antisense strand of SEQ ID NO: 703.

In some embodiments, the RNAi agent has a modified sense strand of SEQ ID NO: 716 conjugated to Formula IV at 3' end. In some embodiments, the RNAi agent has a modified antisense strand of SEQ ID NO: 704. In some embodiments, the RNAi agent has a modified sense strand of SEQ ID NO: 716 conjugated to Formula IV at 3' end and a modified antisense strand of SEQ ID NO: 704.

In some embodiments, the RNAi agent has a modified sense strand of SEQ ID NO: 717 conjugated to Formula IV at 3' end. In some embodiments, the RNAi agent has a modified antisense strand of SEQ ID NO: 705. In some embodiments, the RNAi agent has a modified sense strand of SEQ ID NO: 717 conjugated to Formula IV at 3' end and a modified antisense strand of SEQ ID NO: 705.

In some embodiments, the RNAi agent has a modified sense strand of SEQ ID NO: 718 conjugated to Formula IV at 3' end. In some embodiments, the RNAi agent has a modified antisense strand of SEQ ID NO: 706. In some embodiments, the RNAi agent has a modified sense strand of SEQ ID NO: 718 conjugated to Formula IV at 3' end and a modified antisense strand of SEQ ID NO: 706.

In some embodiments, the RNAi agent has a modified sense strand of SEQ ID NO: 719 conjugated to Formula IV at 3' end. In some embodiments, the RNAi agent has a modified antisense strand of SEQ ID NO: 707. In some embodiments, the RNAi agent has a modified sense strand of SEQ ID NO: 719 conjugated to Formula IV at 3' end and a modified antisense strand of SEQ ID NO: 707.

In some embodiments, the RNAi agent has a modified sense strand of SEQ ID NO: 720 conjugated to Formula IV at 3' end. In some embodiments, the RNAi agent has a modified antisense strand of SEQ ID NO: 708. In some embodiments, the RNAi agent has a modified sense strand of SEQ ID NO: 720 conjugated to Formula IV at 3' end and a modified antisense strand of SEQ ID NO: 708.

In some embodiments, the RNAi agent has a modified sense strand of SEQ ID NO: 721 conjugated to Formula IV at 3' end. In some embodiments, the RNAi agent has a modified antisense strand of SEQ ID NO: 709. In some embodiments, the RNAi agent has a modified sense strand of SEQ ID NO: 721 conjugated to Formula IV at 3' end and a modified antisense strand of SEQ ID NO: 709.

In some embodiments, the RNAi agent has a modified sense strand of SEQ ID NO: 722 conjugated to Formula IV at 3' end. In some embodiments, the RNAi agent has a modified antisense strand of SEQ ID NO: 710. In some embodiments, the RNAi agent has a modified sense strand of SEQ ID NO: 722 conjugated to Formula IV at 3' end and a modified antisense strand of SEQ ID NO: 710.

In some embodiments, the RNAi agent has a modified sense strand of SEQ ID NO: 723 conjugated to Formula IV at 3' end. In some embodiments, the RNAi agent has a modified antisense strand of SEQ ID NO: 711. In some embodiments, the RNAi agent has a modified sense strand of SEQ ID NO: 723 conjugated to Formula IV at 3' end and a modified antisense strand of SEQ ID NO: 711.

In some embodiments, the RNAi agent has a modified sense strand of SEQ ID NO: 724 conjugated to Formula IV at 3' end. In some embodiments, the RNAi agent has a modified antisense strand of SEQ ID NO: 712. In some embodiments, the RNAi agent has a modified sense strand of SEQ ID NO: 724 conjugated to Formula IV at 3' end and a modified antisense strand of SEQ ID NO: 712.

In some embodiments, the RNAi agent has a modified sense strand of SEQ ID NO: 726 conjugated to Formula IV at 3' end. In some embodiments, the RNAi agent has a modified antisense strand of SEQ ID NO: 603. In some embodiments, the RNAi agent has a modified sense strand of SEQ ID NO: 726 conjugated to Formula IV at 3' end and a modified antisense strand of SEQ ID NO: 603.

In some embodiments, the RNAi agent has a modified sense strand of SEQ ID NO: 727 conjugated to Formula IV at 3' end. In some embodiments, the RNAi agent has a modified antisense strand of SEQ ID NO: 596. In some embodiments, the RNAi agent has a modified sense strand of SEQ ID NO: 727 conjugated to Formula IV at 3' end and a modified antisense strand of SEQ ID NO: 596.

In some embodiments, the RNAi agent has a modified sense strand of SEQ ID NO: 728 conjugated to Formula IV at 3' end. In some embodiments, the RNAi agent has a modified antisense strand of SEQ ID NO: 728. In some embodiments, the RNAi agent has a modified sense strand of SEQ ID NO: 703 conjugated to Formula IV at 3' end and a modified antisense strand of SEQ ID NO: 703.

In some embodiments, the RNAi agent has a modified sense strand of SEQ ID NO: 729 conjugated to Formula IV at 3' end. In some embodiments, the RNAi agent has a modified antisense strand of SEQ ID NO: 701. In some embodiments, the RNAi agent has a modified sense strand of SEQ ID NO: 729 conjugated to Formula IV at 3' end and a modified antisense strand of SEQ ID NO: 701.

In some embodiments, the RNAi agent has a modified sense strand of SEQ ID NO: 730 conjugated to Formula IV at 3' end. In some embodiments, the RNAi agent has a modified antisense strand of SEQ ID NO: 595. In some embodiments, the RNAi agent has a modified sense strand of SEQ ID NO: 730 conjugated to Formula IV at 3' end and a modified antisense strand of SEQ ID NO: 595.

In some embodiments, the RNAi agent has a modified sense strand of SEQ ID NO: 731 conjugated to Formula IV at 3' end. In some embodiments, the RNAi agent has a modified antisense strand of SEQ ID NO: 704. In some embodiments, the RNAi agent has a modified sense strand of SEQ ID NO: 731 conjugated to Formula IV at 3' end and a modified antisense strand of SEQ ID NO: 704.

In some embodiments, the RNAi agent has a modified sense strand of SEQ ID NO: 604 conjugated to Formula V at 3' end. In some embodiments, the RNAi agent has a modified antisense strand of SEQ ID NO: 531. In some embodiments, the RNAi agent has a modified sense strand of SEQ ID NO: 604 conjugated to Formula V at 3' end and a modified antisense strand of SEQ ID NO: 531.

In some embodiments, the RNAi agent has a modified sense strand of SEQ ID NO: 605 conjugated to Formula V at 3' end. In some embodiments, the RNAi agent has a modified antisense strand of SEQ ID NO: 532. In some embodiments, the RNAi agent has a modified sense strand of SEQ ID NO: 605 conjugated to Formula V at 3' end and a modified antisense strand of SEQ ID NO: 532.

In some embodiments, the RNAi agent has a modified sense strand of SEQ ID NO: 606 conjugated to Formula V at 3' end. In some embodiments, the RNAi agent has a modified antisense strand of SEQ ID NO: 533. In some embodiments, the RNAi agent has a modified sense strand of SEQ ID NO: 606 conjugated to Formula V at 3' end and a modified antisense strand of SEQ ID NO: 533.

In some embodiments, the RNAi agent has a modified sense strand of SEQ ID NO: 607 conjugated to Formula V at 3' end. In some embodiments, the RNAi agent has a modified antisense strand of SEQ ID NO: 534. In some embodiments, the RNAi agent has a modified sense strand of SEQ ID NO: 607 conjugated to Formula V at 3' end and a modified antisense strand of SEQ ID NO: 534.

In some embodiments, the RNAi agent has a modified sense strand of SEQ ID NO: 608 conjugated to Formula V at 3' end. In some embodiments, the RNAi agent has a modified antisense strand of SEQ ID NO: 535. In some embodiments, the RNAi agent has a modified sense strand of SEQ ID NO: 608 conjugated to Formula V at 3' end and a modified antisense strand of SEQ ID NO: 535.

In some embodiments, the RNAi agent has a modified sense strand of SEQ ID NO: 609 conjugated to Formula V at 3' end. In some embodiments, the RNAi agent has a modified antisense strand of SEQ ID NO: 536. In some embodiments, the RNAi agent has a modified sense strand of SEQ ID NO: 609 conjugated to Formula V at 3' end and a modified antisense strand of SEQ ID NO: 536.

In some embodiments, the RNAi agent has a modified sense strand of SEQ ID NO: 610 conjugated to Formula V at 3' end. In some embodiments, the RNAi agent has a modified antisense strand of SEQ ID NO: 537. In some embodiments, the RNAi agent has a modified sense strand of SEQ ID NO: 610 conjugated to Formula V at 3' end and a modified antisense strand of SEQ ID NO: 537.

In some embodiments, the RNAi agent has a modified sense strand of SEQ ID NO: 611 conjugated to Formula V at 3' end. In some embodiments, the RNAi agent has a modified antisense strand of SEQ ID NO: 538. In some embodiments, the RNAi agent has a modified sense strand of SEQ ID NO: 611 conjugated to Formula V at 3' end and a modified antisense strand of SEQ ID NO: 538.

In some embodiments, the RNAi agent has a modified sense strand of SEQ ID NO: 612 conjugated to Formula V at 3' end. In some embodiments, the RNAi agent has a modified antisense strand of SEQ ID NO: 539. In some embodiments, the RNAi agent has a modified sense strand of SEQ ID NO: 612 conjugated to Formula V at 3' end and a modified antisense strand of SEQ ID NO: 539.

In some embodiments, the RNAi agent has a modified sense strand of SEQ ID NO: 613 conjugated to Formula V at 3' end. In some embodiments, the RNAi agent has a modified antisense strand of SEQ ID NO: 540. In some embodiments, the RNAi agent has a modified sense strand of SEQ ID NO: 613 conjugated to Formula V at 3' end and a modified antisense strand of SEQ ID NO: 540.

In some embodiments, the RNAi agent has a modified sense strand of SEQ ID NO: 614 conjugated to Formula V at 3' end. In some embodiments, the RNAi agent has a modified antisense strand of SEQ ID NO: 541. In some embodiments, the RNAi agent has a modified sense strand of SEQ ID NO: 614 conjugated to Formula V at 3' end and a modified antisense strand of SEQ ID NO: 541.

In some embodiments, the RNAi agent has a modified sense strand of SEQ ID NO: 615 conjugated to Formula V at 3' end. In some embodiments, the RNAi agent has a modified antisense strand of SEQ ID NO: 542. In some embodiments, the RNAi agent has a modified sense strand of SEQ ID NO: 615 conjugated to Formula V at 3' end and a modified antisense strand of SEQ ID NO: 542.

In some embodiments, the RNAi agent has a modified sense strand of SEQ ID NO: 616 conjugated to Formula V at 3' end. In some embodiments, the RNAi agent has a modified antisense strand of SEQ ID NO: 543. In some embodiments, the RNAi agent has a modified sense strand of SEQ ID NO: 616 conjugated to Formula V at 3' end and a modified antisense strand of SEQ ID NO: 543.

In some embodiments, the RNAi agent has a modified sense strand of SEQ ID NO: 617 conjugated to Formula V at 3' end. In some embodiments, the RNAi agent has a modified antisense strand of SEQ ID NO: 544. In some embodiments, the RNAi agent has a modified sense strand of SEQ ID NO: 617 conjugated to Formula V at 3' end and a modified antisense strand of SEQ ID NO: 544.

In some embodiments, the RNAi agent has a modified sense strand of SEQ ID NO:

618 conjugated to Formula V at 3' end. In some embodiments, the RNAi agent has a modified antisense strand of SEQ ID NO: 545. In some embodiments, the RNAi agent has a modified sense strand of SEQ ID NO: 618 conjugated to Formula V at 3' end and a modified antisense strand of SEQ ID NO: 545.

In some embodiments, the RNAi agent has a modified sense strand of SEQ ID NO: 619 conjugated to Formula V at 3' end. In some embodiments, the RNAi agent has a modified antisense strand of SEQ ID NO: 546. In some embodiments, the RNAi agent has a modified sense strand of SEQ ID NO: 619 conjugated to Formula V at 3' end and a modified antisense strand of SEQ ID NO: 546.

In some embodiments, the RNAi agent has a modified sense strand of SEQ ID NO: 620 conjugated to Formula V at 3' end. In some embodiments, the RNAi agent has a modified antisense strand of SEQ ID NO: 547. In some embodiments, the RNAi agent has a modified sense strand of SEQ ID NO: 620 conjugated to Formula V at 3' end and a modified antisense strand of SEQ ID NO: 547.

In some embodiments, the RNAi agent has a modified sense strand of SEQ ID NO: 621 conjugated to Formula V at 3' end. In some embodiments, the RNAi agent has a modified antisense strand of SEQ ID NO: 548. In some embodiments, the RNAi agent has a modified sense strand of SEQ ID NO: 621 conjugated to Formula V at 3' end and a modified antisense strand of SEQ ID NO: 548.

In some embodiments, the RNAi agent has a modified sense strand of SEQ ID NO: 622 conjugated to Formula V at 3' end. In some embodiments, the RNAi agent has a modified antisense strand of SEQ ID NO: 549. In some embodiments, the RNAi agent has a modified sense strand of SEQ ID NO: 622 conjugated to Formula V at 3' end and a modified antisense strand of SEQ ID NO: 549.

In some embodiments, the RNAi agent has a modified sense strand of SEQ ID NO: 623 conjugated to Formula V at 3' end. In some embodiments, the RNAi agent has a modified antisense strand of SEQ ID NO: 550. In some embodiments, the RNAi agent has a modified sense strand of SEQ ID NO: 623 conjugated to Formula V at 3' end and a modified antisense strand of SEQ ID NO: 550.

In some embodiments, the RNAi agent has a modified sense strand of SEQ ID NO: 624 conjugated to Formula V at 3' end. In some embodiments, the RNAi agent has a modified antisense strand of SEQ ID NO: 551. In some embodiments, the RNAi agent has a modified sense strand of SEQ ID NO: 624 conjugated to Formula V at 3' end and a modified antisense strand of SEQ ID NO: 551.

In some embodiments, the RNAi agent has a modified sense strand of SEQ ID NO: 625 conjugated to Formula V at 3' end. In some embodiments, the RNAi agent has a modified antisense strand of SEQ ID NO: 552. In some embodiments, the RNAi agent has a modified sense strand of SEQ ID NO: 625 conjugated to Formula V at 3' end and a modified antisense strand of SEQ ID NO: 552.

In some embodiments, the RNAi agent has a modified sense strand of SEQ ID NO: 626 conjugated to Formula V at 3' end. In some embodiments, the RNAi agent has a modified antisense strand of SEQ ID NO: 553. In some embodiments, the RNAi agent has a modified sense strand of SEQ ID NO: 626 conjugated to Formula V at 3' end and a modified antisense strand of SEQ ID NO: 553.

In some embodiments, the RNAi agent has a modified sense strand of SEQ ID NO: 627 conjugated to Formula V at 3' end. In some embodiments, the RNAi agent has a modified antisense strand of SEQ ID NO: 554. In some embodiments, the RNAi agent has a modified sense strand of SEQ ID NO: 627 conjugated to Formula V at 3' end and a modified antisense strand of SEQ ID NO: 554.

In some embodiments, the RNAi agent has a modified sense strand of SEQ ID NO: 628 conjugated to Formula V at 3' end. In some embodiments, the RNAi agent has a modified antisense strand of SEQ ID NO: 555. In some embodiments, the RNAi agent has a modified sense strand of SEQ ID NO: 628 conjugated to Formula V at 3' end and a modified antisense strand of SEQ ID NO: 555.

In some embodiments, the RNAi agent has a modified sense strand of SEQ ID NO: 629 conjugated to Formula V at 3' end. In some embodiments, the RNAi agent has a modified antisense strand of SEQ ID NO: 5526. In some embodiments, the RNAi agent has a modified sense strand of SEQ ID NO: 629 conjugated to Formula V at 3' end and a modified antisense strand of SEQ ID NO: 556.

In some embodiments, the RNAi agent has a modified sense strand of SEQ ID NO: 630 conjugated to Formula V at 3' end. In some embodiments, the RNAi agent has a modified antisense strand of SEQ ID NO: 557. In some embodiments, the RNAi agent has a modified sense strand of SEQ ID NO: 630 conjugated to Formula V at 3' end and a modified antisense strand of SEQ ID NO: 557.

In some embodiments, the RNAi agent has a modified sense strand of SEQ ID NO: 631 conjugated to Formula V at 3' end. In some embodiments, the RNAi agent has a modified antisense strand of SEQ ID NO: 558. In some embodiments, the RNAi agent has a modified sense strand of SEQ ID NO: 631 conjugated to Formula V at 3' end and a modified antisense strand of SEQ ID NO: 558.

In some embodiments, the RNAi agent has a modified sense strand of SEQ ID NO: 632 conjugated to Formula V at 3' end. In some embodiments, the RNAi agent has a modified antisense strand of SEQ ID NO: 559. In some embodiments, the RNAi agent has a modified sense strand of SEQ ID NO: 632 conjugated to Formula V at 3' end and a modified antisense strand of SEQ ID NO: 559.

In some embodiments, the RNAi agent has a modified sense strand of SEQ ID NO: 633 conjugated to Formula V at 3' end. In some embodiments, the RNAi agent has a modified antisense strand of SEQ ID NO: 560. In some embodiments, the RNAi agent has a modified sense strand of SEQ ID NO: 633 conjugated to Formula V at 3' end and a modified antisense strand of SEQ ID NO: 560.

In some embodiments, the RNAi agent has a modified sense strand of SEQ ID NO: 634 conjugated to Formula V at 3' end. In some embodiments, the RNAi agent has a modified antisense strand of SEQ ID NO: 561. In some embodiments, the RNAi agent has a modified sense strand of SEQ ID NO: 634 conjugated to Formula V at 3' end and a modified antisense strand of SEQ ID NO: 561.

In some embodiments, the RNAi agent has a modified sense strand of SEQ ID NO: 635 conjugated to Formula V at 3' end. In some embodiments, the RNAi agent has a modified antisense strand of SEQ ID NO: 562. In some embodiments, the RNAi agent has a modified sense strand of SEQ ID NO: 635 conjugated to Formula V at 3' end and a modified antisense strand of SEQ ID NO: 562.

In some embodiments, the RNAi agent has a modified sense strand of SEQ ID NO: 636 conjugated to Formula V at 3' end. In some embodiments, the RNAi agent has a modified antisense strand of SEQ ID NO: 563. In some embodiments, the RNAi agent has a modified sense strand of SEQ ID NO: 636 conjugated to Formula V at 3' end and a modified antisense strand of SEQ ID NO: 563.

In some embodiments, the RNAi agent has a modified sense strand of SEQ ID NO: 637 conjugated to Formula V at 3' end. In some embodiments, the RNAi agent has a modified antisense strand of SEQ ID NO: 564. In some embodiments, the RNAi agent has a modified sense strand of SEQ ID NO: 637 conjugated to Formula V at 3' end and a modified antisense strand of SEQ ID NO: 564.

In some embodiments, the RNAi agent has a modified sense strand of SEQ ID NO: 638 conjugated to Formula V at 3' end. In some embodiments, the RNAi agent has a modified antisense strand of SEQ ID NO: 565. In some embodiments, the RNAi agent has a modified sense strand of SEQ ID NO: 638 conjugated to Formula V at 3' end and a modified antisense strand of SEQ ID NO: 565.

In some embodiments, the RNAi agent has a modified sense strand of SEQ ID NO: 639 conjugated to Formula V at 3' end. In some embodiments, the RNAi agent has a modified antisense strand of SEQ ID NO: 566. In some embodiments, the RNAi agent has a modified sense strand of SEQ ID NO: 639 conjugated to Formula V at 3' end and a modified antisense strand of SEQ ID NO: 566.

In some embodiments, the RNAi agent has a modified sense strand of SEQ ID NO: 640 conjugated to Formula V at 3' end. In some embodiments, the RNAi agent has a modified antisense strand of SEQ ID NO: 567. In some embodiments, the RNAi agent has a modified sense strand of SEQ ID NO: 640 conjugated to Formula V at 3' end and a modified antisense strand of SEQ ID NO: 567.

In some embodiments, the RNAi agent has a modified sense strand of SEQ ID NO: 641 conjugated to Formula V at 3' end. In some embodiments, the RNAi agent has a modified antisense strand of SEQ ID NO: 568. In some embodiments, the RNAi agent has a modified sense strand of SEQ ID NO: 641 conjugated to Formula V at 3' end and a modified antisense strand of SEQ ID NO: 568.

In some embodiments, the RNAi agent has a modified sense strand of SEQ ID NO: 642 conjugated to Formula V at 3' end. In some embodiments, the RNAi agent has a modified antisense strand of SEQ ID NO: 569. In some embodiments, the RNAi agent has a modified sense strand of SEQ ID NO: 642 conjugated to Formula V at 3' end and a modified antisense strand of SEQ ID NO: 569.

In some embodiments, the RNAi agent has a modified sense strand of SEQ ID NO: 643 conjugated to Formula V at 3' end. In some embodiments, the RNAi agent has a modified antisense strand of SEQ ID NO: 570. In some embodiments, the RNAi agent has a modified sense strand of SEQ ID NO: 643 conjugated to Formula V at 3' end and a modified antisense strand of SEQ ID NO: 570.

In some embodiments, the RNAi agent has a modified sense strand of SEQ ID NO: 644 conjugated to Formula V at 3' end. In some embodiments, the RNAi agent has a modified antisense strand of SEQ ID NO: 571. In some embodiments, the RNAi agent has a modified sense strand of SEQ ID NO: 644 conjugated to Formula V at 3' end and a modified antisense strand of SEQ ID NO: 571.

In some embodiments, the RNAi agent has a modified sense strand of SEQ ID NO: 645 conjugated to Formula V at 3' end. In some embodiments, the RNAi agent has a modified antisense strand of SEQ ID NO: 572. In some embodiments, the RNAi agent has a modified sense strand of SEQ ID NO: 645 conjugated to Formula V at 3' end and a modified antisense strand of SEQ ID NO: 572.

In some embodiments, the RNAi agent has a modified sense strand of SEQ ID NO: 646 conjugated to Formula V at 3' end. In some embodiments, the RNAi agent has a modified antisense strand of SEQ ID NO: 573. In some embodiments, the RNAi agent has a modified sense strand of SEQ ID NO: 646 conjugated to Formula V at 3' end and a modified antisense strand of SEQ ID NO: 573.

In some embodiments, the RNAi agent has a modified sense strand of SEQ ID NO: 647 conjugated to Formula V at 3' end. In some embodiments, the RNAi agent has a modified antisense strand of SEQ ID NO: 574. In some embodiments, the RNAi agent has a modified sense strand of SEQ ID NO: 647 conjugated to Formula V at 3' end and a modified antisense strand of SEQ ID NO: 574.

In some embodiments, the RNAi agent has a modified sense strand of SEQ ID NO: 648 conjugated to Formula V at 3' end. In some embodiments, the RNAi agent has a modified antisense strand of SEQ ID NO: 575. In some embodiments, the RNAi agent has a modified sense strand of SEQ ID NO: 648 conjugated to Formula V at 3' end and a modified antisense strand of SEQ ID NO: 575.

In some embodiments, the RNAi agent has a modified sense strand of SEQ ID NO: 649 conjugated to Formula V at 3' end. In some embodiments, the RNAi agent has a modified antisense strand of SEQ ID NO: 576. In some embodiments, the RNAi agent has a modified sense strand of SEQ ID NO: 649 conjugated to Formula V at 3' end and a modified antisense strand of SEQ ID NO: 576.

In some embodiments, the RNAi agent has a modified sense strand of SEQ ID NO: 650 conjugated to Formula V at 3' end. In some embodiments, the RNAi agent has a modified antisense strand of SEQ ID NO: 577. In some embodiments, the RNAi agent has a modified sense strand of SEQ ID NO: 650 conjugated to Formula V at 3' end and a modified antisense strand of SEQ ID NO: 577.

In some embodiments, the RNAi agent has a modified sense strand of SEQ ID NO: 651 conjugated to Formula V at 3' end. In some embodiments, the RNAi agent has a modified antisense strand of SEQ ID NO: 578. In some embodiments, the RNAi agent has a modified sense strand of SEQ ID NO: 651 conjugated to Formula V at 3' end and a modified antisense strand of SEQ ID NO: 578.

In some embodiments, the RNAi agent has a modified sense strand of SEQ ID NO: 652 conjugated to Formula V at 3' end. In some embodiments, the RNAi agent has a modified antisense strand of SEQ ID NO: 579. In some embodiments, the RNAi agent has a modified sense strand of SEQ ID NO: 652 conjugated to Formula V at 3' end and a modified antisense strand of SEQ ID NO: 579.

In some embodiments, the RNAi agent has a modified sense strand of SEQ ID NO: 653 conjugated to Formula V at 3' end. In some embodiments, the RNAi agent has a modified antisense strand of SEQ ID NO: 580. In some embodiments, the RNAi agent has a modified sense strand of SEQ ID NO: 653 conjugated to Formula V at 3' end and a modified antisense strand of SEQ ID NO: 580.

In some embodiments, the RNAi agent has a modified sense strand of SEQ ID NO: 654 conjugated to Formula V at 3' end. In some embodiments, the RNAi agent has a modified antisense strand of SEQ ID NO: 581. In some embodiments, the RNAi agent has a modified sense strand of SEQ ID NO: 654 conjugated to Formula V at 3' end and a modified antisense strand of SEQ ID NO: 581.

In some embodiments, the RNAi agent has a modified sense strand of SEQ ID NO: 655 conjugated to Formula V at 3' end. In some embodiments, the RNAi agent has a modified antisense strand of SEQ ID NO: 581. In some embodiments, the RNAi agent has a modified sense strand of SEQ ID NO: 655 conjugated to Formula V at 3' end and a modified antisense strand of SEQ ID NO: 581.

In some embodiments, the RNAi agent has a modified sense strand of SEQ ID NO: 656 conjugated to Formula V at 3' end. In some embodiments, the RNAi agent has a modified antisense strand of SEQ ID NO: 583. In some embodiments, the RNAi agent has a modified sense strand of SEQ ID NO: 656 conjugated to Formula V at 3' end and a modified antisense strand of SEQ ID NO: 583.

In some embodiments, the RNAi agent has a modified sense strand of SEQ ID NO: 657 conjugated to Formula V at 3' end. In some embodiments, the RNAi agent has a modified antisense strand of SEQ ID NO: 584. In some embodiments, the RNAi agent has a modified sense strand of SEQ ID NO: 657 conjugated to Formula V at 3' end and a modified antisense strand of SEQ ID NO: 584.

In some embodiments, the RNAi agent has a modified sense strand of SEQ ID NO: 658 conjugated to Formula V at 3' end. In some embodiments, the RNAi agent has a modified antisense strand of SEQ ID NO: 585. In some embodiments, the RNAi agent has a modified sense strand of SEQ ID NO: 658 conjugated to Formula V at 3' end and a modified antisense strand of SEQ ID NO: 585.

In some embodiments, the RNAi agent has a modified sense strand of SEQ ID NO: 659 conjugated to Formula V at 3' end. In some embodiments, the RNAi agent has a modified antisense strand of SEQ ID NO: 586. In some embodiments, the RNAi agent has a modified sense strand of SEQ ID NO: 659 conjugated to Formula V at 3' end and a modified antisense strand of SEQ ID NO: 586.

In some embodiments, the RNAi agent has a modified sense strand of SEQ ID NO: 660 conjugated to Formula V at 3' end. In some embodiments, the RNAi agent has a modified antisense strand of SEQ ID NO: 587. In some embodiments, the RNAi agent has a modified sense strand of SEQ ID NO: 660 conjugated to Formula V at 3' end and a modified antisense strand of SEQ ID NO: 587.

In some embodiments, the RNAi agent has a modified sense strand of SEQ ID NO: 661 conjugated to Formula V at 3' end. In some embodiments, the RNAi agent has a modified antisense strand of SEQ ID NO: 588. In some embodiments, the RNAi agent has a modified sense strand of SEQ ID NO: 661 conjugated to Formula V at 3' end and a modified antisense strand of SEQ ID NO: 588.

In some embodiments, the RNAi agent has a modified sense strand of SEQ ID NO: 662 conjugated to Formula V at 3' end. In some embodiments, the RNAi agent has a modified antisense strand of SEQ ID NO: 589. In some embodiments, the RNAi agent has a modified sense strand of SEQ ID NO: 662 conjugated to Formula V at 3' end and a modified antisense strand of SEQ ID NO: 589.

In some embodiments, the RNAi agent has a modified sense strand of SEQ ID NO: 663 conjugated to Formula V at 3' end. In some embodiments, the RNAi agent has a modified antisense strand of SEQ ID NO: 590. In some embodiments, the RNAi agent has a modified sense strand of SEQ ID NO: 663 conjugated to Formula V at 3' end and a modified antisense strand of SEQ ID NO: 590.

In some embodiments, the RNAi agent has a modified sense strand of SEQ ID NO: 664 conjugated to Formula V at 3' end. In some embodiments, the RNAi agent has a modified antisense strand of SEQ ID NO: 591. In some embodiments, the RNAi agent has a modified sense strand of SEQ ID NO: 664 conjugated to Formula V at 3' end and a modified antisense strand of SEQ ID NO: 591.

In some embodiments, the RNAi agent has a modified sense strand of SEQ ID NO: 665 conjugated to Formula V at 3' end. In some embodiments, the RNAi agent has a modified antisense strand of SEQ ID NO: 592. In some embodiments, the RNAi agent has a modified sense strand of SEQ ID NO: 665 conjugated to Formula V at 3' end and a modified antisense strand of SEQ ID NO: 592.

In some embodiments, the RNAi agent has a modified sense strand of SEQ ID NO: 666 conjugated to Formula V at 3' end. In some embodiments, the RNAi agent has a modified antisense strand of SEQ ID NO: 593. In some embodiments, the RNAi agent has a modified sense strand of SEQ ID NO: 666 conjugated to Formula V at 3' end and a modified antisense strand of SEQ ID NO: 593.

In some embodiments, the RNAi agent has a modified sense strand of SEQ ID NO: 667 conjugated to Formula V at 3' end. In some embodiments, the RNAi agent has a modified antisense strand of SEQ ID NO: 594. In some embodiments, the RNAi agent has a modified sense strand of SEQ ID NO: 667 conjugated to Formula V at 3' end and a modified antisense strand of SEQ ID NO: 594.

In some embodiments, the RNAi agent has a modified sense strand of SEQ ID NO: 668 conjugated to Formula V at 3' end. In some embodiments, the RNAi agent has a modified antisense strand of SEQ ID NO: 595. In some embodiments, the RNAi agent has a modified sense strand of SEQ ID NO: 668 conjugated to Formula V at 3' end and a modified antisense strand of SEQ ID NO: 595.

In some embodiments, the RNAi agent has a modified sense strand of SEQ ID NO: 669 conjugated to Formula V at 3' end. In some embodiments, the RNAi agent has a modified antisense strand of SEQ ID NO: 596. In some embodiments, the RNAi agent has a modified sense strand of SEQ ID NO: 669 conjugated to Formula V at 3' end and a modified antisense strand of SEQ ID NO: 596.

In some embodiments, the RNAi agent has a modified sense strand of SEQ ID NO:

670 conjugated to Formula V at 3' end. In some embodiments, the RNAi agent has a modified antisense strand of SEQ ID NO: 597. In some embodiments, the RNAi agent has a modified sense strand of SEQ ID NO: 670 conjugated to Formula V at 3' end and a modified antisense strand of SEQ ID NO: 597.

In some embodiments, the RNAi agent has a modified sense strand of SEQ ID NO: 671 conjugated to Formula V at 3' end. In some embodiments, the RNAi agent has a modified antisense strand of SEQ ID NO: 598. In some embodiments, the RNAi agent has a modified sense strand of SEQ ID NO: 671 conjugated to Formula V at 3' end and a modified antisense strand of SEQ ID NO: 598.

In some embodiments, the RNAi agent has a modified sense strand of SEQ ID NO: 672 conjugated to Formula V at 3' end. In some embodiments, the RNAi agent has a modified antisense strand of SEQ ID NO: 599. In some embodiments, the RNAi agent has a modified sense strand of SEQ ID NO: 672 conjugated to Formula V at 3' end and a modified antisense strand of SEQ ID NO: 599.

In some embodiments, the RNAi agent has a modified sense strand of SEQ ID NO: 673 conjugated to Formula V at 3' end. In some embodiments, the RNAi agent has a modified antisense strand of SEQ ID NO: 600. In some embodiments, the RNAi agent has a modified sense strand of SEQ ID NO: 673 conjugated to Formula V at 3' end and a modified antisense strand of SEQ ID NO: 600.

In some embodiments, the RNAi agent has a modified sense strand of SEQ ID NO: 674 conjugated to Formula V at 3' end. In some embodiments, the RNAi agent has a modified antisense strand of SEQ ID NO: 601. In some embodiments, the RNAi agent has a modified sense strand of SEQ ID NO: 674 conjugated to Formula V at 3' end and a modified antisense strand of SEQ ID NO: 601.

In some embodiments, the RNAi agent has a modified sense strand of SEQ ID NO: 675 conjugated to Formula V at 3' end. In some embodiments, the RNAi agent has a modified antisense strand of SEQ ID NO: 602. In some embodiments, the RNAi agent has a modified sense strand of SEQ ID NO: 675 conjugated to Formula V at 3' end and a modified antisense strand of SEQ ID NO: 602.

In some embodiments, the RNAi agent has a modified sense strand of SEQ ID NO: 676 conjugated to Formula V at 3' end. In some embodiments, the RNAi agent has a modified antisense strand of SEQ ID NO: 603. In some embodiments, the RNAi agent has a modified sense strand of SEQ ID NO: 676 conjugated to Formula V at 3' end and a modified antisense strand of SEQ ID NO: 603.

In some embodiments, the RNAi agent has a modified sense strand of SEQ ID NO: 713 conjugated to Formula V at 3' end. In some embodiments, the RNAi agent has a modified antisense strand of SEQ ID NO: 701. In some embodiments, the RNAi agent has a modified sense strand of SEQ ID NO: 713 conjugated to Formula V at 3' end and a modified antisense strand of SEQ ID NO: 701.

In some embodiments, the RNAi agent has a modified sense strand of SEQ ID NO: 714 conjugated to Formula V at 3' end. In some embodiments, the RNAi agent has a modified antisense strand of SEQ ID NO: 702. In some embodiments, the RNAi agent has a modified sense strand of SEQ ID NO: 714 conjugated to Formula V at 3' end and a modified antisense strand of SEQ ID NO: 702.

In some embodiments, the RNAi agent has a modified sense strand of SEQ ID NO: 715 conjugated to Formula V at 3' end. In some embodiments, the RNAi agent has a modified antisense strand of SEQ ID NO: 703. In some embodiments, the RNAi agent has a modified sense strand of SEQ ID NO: 715 conjugated to Formula V at 3' end and a modified antisense strand of SEQ ID NO: 703.

In some embodiments, the RNAi agent has a modified sense strand of SEQ ID NO: 716 conjugated to Formula V at 3' end. In some embodiments, the RNAi agent has a modified antisense strand of SEQ ID NO: 704. In some embodiments, the RNAi agent has a modified sense strand of SEQ ID NO: 716 conjugated to Formula V at 3' end and a modified antisense strand of SEQ ID NO: 704.

In some embodiments, the RNAi agent has a modified sense strand of SEQ ID NO: 717 conjugated to Formula V at 3' end. In some embodiments, the RNAi agent has a modified antisense strand of SEQ ID NO: 705. In some embodiments, the RNAi agent has a modified sense strand of SEQ ID NO: 717 conjugated to Formula V at 3' end and a modified antisense strand of SEQ ID NO: 705.

In some embodiments, the RNAi agent has a modified sense strand of SEQ ID NO: 718 conjugated to Formula V at 3' end. In some embodiments, the RNAi agent has a modified antisense strand of SEQ ID NO: 706. In some embodiments, the RNAi agent has a modified sense strand of SEQ ID NO: 718 conjugated to Formula V at 3' end and a modified antisense strand of SEQ ID NO: 706.

In some embodiments, the RNAi agent has a modified sense strand of SEQ ID NO: 719 conjugated to Formula V at 3' end. In some embodiments, the RNAi agent has a modified antisense strand of SEQ ID NO: 707. In some embodiments, the RNAi agent has a modified sense strand of SEQ ID NO: 719 conjugated to Formula V at 3' end and a modified antisense strand of SEQ ID NO: 707.

In some embodiments, the RNAi agent has a modified sense strand of SEQ ID NO: 720 conjugated to Formula V at 3' end. In some embodiments, the RNAi agent has a modified antisense strand of SEQ ID NO: 708. In some embodiments, the RNAi agent has a modified sense strand of SEQ ID NO: 720 conjugated to Formula V at 3' end and a modified antisense strand of SEQ ID NO: 708.

In some embodiments, the RNAi agent has a modified sense strand of SEQ ID NO: 721 conjugated to Formula V at 3' end. In some embodiments, the RNAi agent has a modified antisense strand of SEQ ID NO: 709. In some embodiments, the RNAi agent has a modified sense strand of SEQ ID NO: 721 conjugated to Formula V at 3' end and a modified antisense strand of SEQ ID NO: 709.

In some embodiments, the RNAi agent has a modified sense strand of SEQ ID NO: 722 conjugated to Formula V at 3' end. In some embodiments, the RNAi agent has a modified antisense strand of SEQ ID NO: 710. In some embodiments, the RNAi agent has a modified sense strand of SEQ ID NO: 722 conjugated to Formula V at 3' end and a modified antisense strand of SEQ ID NO: 710.

In some embodiments, the RNAi agent has a modified sense strand of SEQ ID NO: 723 conjugated to Formula V at 3' end. In some embodiments, the RNAi agent has a modified antisense strand of SEQ ID NO: 711. In some embodiments, the RNAi agent has a modified sense strand of SEQ ID NO: 723 conjugated to Formula V at 3' end and a modified antisense strand of SEQ ID NO: 711.

In some embodiments, the RNAi agent has a modified sense strand of SEQ ID NO: 724 conjugated to Formula V at 3' end. In some embodiments, the RNAi agent has a modified antisense strand of SEQ ID NO: 712. In some embodiments, the RNAi agent has a modified sense strand of SEQ ID NO: 724 conjugated to Formula V at 3' end and a modified antisense strand of SEQ ID NO: 712.

In some embodiments, the RNAi agent has a modified sense strand of SEQ ID NO: 726 conjugated to Formula V at 3' end. In some embodiments, the RNAi agent has a modified antisense strand of SEQ ID NO: 603. In some embodiments, the RNAi agent has a modified sense strand of SEQ ID NO: 726 conjugated to Formula V at 3' end and a modified antisense strand of SEQ ID NO: 603.

In some embodiments, the RNAi agent has a modified sense strand of SEQ ID NO: 727 conjugated to Formula V at 3' end. In some embodiments, the RNAi agent has a modified antisense strand of SEQ ID NO: 596. In some embodiments, the RNAi agent has a modified sense strand of SEQ ID NO: 727 conjugated to Formula V at 3' end and a modified antisense strand of SEQ ID NO: 596.

In some embodiments, the RNAi agent has a modified sense strand of SEQ ID NO: 728 conjugated to Formula V at 3' end. In some embodiments, the RNAi agent has a modified antisense strand of SEQ ID NO: 728. In some embodiments, the RNAi agent has a modified sense strand of SEQ ID NO: 703 conjugated to Formula V at 3' end and a modified antisense strand of SEQ ID NO: 703.

In some embodiments, the RNAi agent has a modified sense strand of SEQ ID NO: 729 conjugated to Formula V at 3' end. In some embodiments, the RNAi agent has a modified antisense strand of SEQ ID NO: 701. In some embodiments, the RNAi agent has a modified sense strand of SEQ ID NO: 729 conjugated to Formula V at 3' end and a modified antisense strand of SEQ ID NO: 701.

In some embodiments, the RNAi agent has a modified sense strand of SEQ ID NO: 730 conjugated to Formula V at 3' end. In some embodiments, the RNAi agent has a modified antisense strand of SEQ ID NO: 595. In some embodiments, the RNAi agent has a modified sense strand of SEQ ID NO: 730 conjugated to Formula V at 3' end and a modified antisense strand of SEQ ID NO: 595.

In some embodiments, the RNAi agent has a modified sense strand of SEQ ID NO: 731 conjugated to Formula V at 3' end. In some embodiments, the RNAi agent has a modified antisense strand of SEQ ID NO: 704. In some embodiments, the RNAi agent has a modified sense strand of SEQ ID NO: 731 conjugated to Formula V at 3' end and a modified antisense strand of SEQ ID NO: 704.

In some embodiments, the RNAi agent has a modified sense strand of SEQ ID NO: 604 conjugated to Formula VI at 3' end. In some embodiments, the RNAi agent has a modified antisense strand of SEQ ID NO: 531. In some embodiments, the RNAi agent has a modified sense strand of SEQ ID NO: 604 conjugated to Formula VI at 3' end and a modified antisense strand of SEQ ID NO: 531.

In some embodiments, the RNAi agent has a modified sense strand of SEQ ID NO: 605 conjugated to Formula VI at 3' end. In some embodiments, the RNAi agent has a modified antisense strand of SEQ ID NO: 532. In some embodiments, the RNAi agent has a modified sense strand of SEQ ID NO: 605 conjugated to Formula VI at 3' end and a modified antisense strand of SEQ ID NO: 532.

In some embodiments, the RNAi agent has a modified sense strand of SEQ ID NO: 606 conjugated to Formula VI at 3' end. In some embodiments, the RNAi agent has a modified antisense strand of SEQ ID NO: 533. In some embodiments, the RNAi agent has a modified sense strand of SEQ ID NO: 606 conjugated to Formula VI at 3' end and a modified antisense strand of SEQ ID NO: 533.

In some embodiments, the RNAi agent has a modified sense strand of SEQ ID NO: 607 conjugated to Formula VI at 3' end. In some embodiments, the RNAi agent has a modified antisense strand of SEQ ID NO: 534. In some embodiments, the RNAi agent has a modified sense strand of SEQ ID NO: 607 conjugated to Formula VI at 3' end and a modified antisense strand of SEQ ID NO: 534.

In some embodiments, the RNAi agent has a modified sense strand of SEQ ID NO: 608 conjugated to Formula VI at 3' end. In some embodiments, the RNAi agent has a modified antisense strand of SEQ ID NO: 535. In some embodiments, the RNAi agent has a modified sense strand of SEQ ID NO: 608 conjugated to Formula VI at 3' end and a modified antisense strand of SEQ ID NO: 535.

In some embodiments, the RNAi agent has a modified sense strand of SEQ ID NO: 609 conjugated to Formula VI at 3' end. In some embodiments, the RNAi agent has a modified antisense strand of SEQ ID NO: 536. In some embodiments, the RNAi agent has a modified sense strand of SEQ ID NO: 609 conjugated to Formula VI at 3' end and a modified antisense strand of SEQ ID NO: 536.

In some embodiments, the RNAi agent has a modified sense strand of SEQ ID NO: 610 conjugated to Formula VI at 3' end. In some embodiments, the RNAi agent has a modified antisense strand of SEQ ID NO: 537. In some embodiments, the RNAi agent has a modified sense strand of SEQ ID NO: 610 conjugated to Formula VI at 3' end and a modified antisense strand of SEQ ID NO: 537.

In some embodiments, the RNAi agent has a modified sense strand of SEQ ID NO: 611 conjugated to Formula VI at 3' end. In some embodiments, the RNAi agent has a modified antisense strand of SEQ ID NO: 538. In some embodiments, the RNAi agent has a modified sense strand of SEQ ID NO: 611 conjugated to Formula VI at 3' end and a modified antisense strand of SEQ ID NO: 538.

In some embodiments, the RNAi agent has a modified sense strand of SEQ ID NO: 612 conjugated to Formula VI at 3' end. In some embodiments, the RNAi agent has a modified antisense strand of SEQ ID NO: 539. In some embodiments, the RNAi agent has a modified sense strand of SEQ ID NO: 612 conjugated to Formula VI at 3' end and a modified antisense strand of SEQ ID NO: 539.

In some embodiments, the RNAi agent has a modified sense strand of SEQ ID NO: 613 conjugated to Formula VI at 3' end. In some embodiments, the RNAi agent has a modified antisense strand of SEQ ID NO: 540. In some embodiments, the RNAi agent has a modified sense strand of SEQ ID NO: 613 conjugated to Formula VI at 3' end and a modified antisense strand of SEQ ID NO: 540.

In some embodiments, the RNAi agent has a modified sense strand of SEQ ID NO: 614 conjugated to Formula VI at 3' end. In some embodiments, the RNAi agent has a modified antisense strand of SEQ ID NO: 541. In some embodiments, the RNAi agent has a modified sense strand of SEQ ID NO: 614 conjugated to Formula VI at 3' end and a modified antisense strand of SEQ ID NO: 541.

In some embodiments, the RNAi agent has a modified sense strand of SEQ ID NO: 615 conjugated to Formula VI at 3' end. In some embodiments, the RNAi agent has a modified antisense strand of SEQ ID NO: 542. In some embodiments, the RNAi agent has a modified sense strand of SEQ ID NO: 615 conjugated to Formula VI at 3' end and a modified antisense strand of SEQ ID NO: 542.

In some embodiments, the RNAi agent has a modified sense strand of SEQ ID NO: 616 conjugated to Formula VI at 3' end. In some embodiments, the RNAi agent has a modified antisense strand of SEQ ID NO: 543. In some embodiments, the RNAi agent has a modified sense strand of SEQ ID NO: 616 conjugated to Formula VI at 3' end and a modified antisense strand of SEQ ID NO: 543.

In some embodiments, the RNAi agent has a modified sense strand of SEQ ID NO: 617 conjugated to Formula VI at 3' end. In some embodiments, the RNAi agent has a modified antisense strand of SEQ ID NO: 544. In some embodiments, the RNAi agent has a modified sense strand of SEQ ID NO: 617 conjugated to Formula VI at 3' end and a modified antisense strand of SEQ ID NO: 544.

In some embodiments, the RNAi agent has a modified sense strand of SEQ ID NO: 618 conjugated to Formula VI at 3' end. In some embodiments, the RNAi agent has a modified antisense strand of SEQ ID NO: 545. In some embodiments, the RNAi agent has a modified sense strand of SEQ ID NO: 618 conjugated to Formula VI at 3' end and a modified antisense strand of SEQ ID NO: 545.

In some embodiments, the RNAi agent has a modified sense strand of SEQ ID NO: 619 conjugated to Formula VI at 3' end. In some embodiments, the RNAi agent has a modified antisense strand of SEQ ID NO: 546. In some embodiments, the RNAi agent has a modified sense strand of SEQ ID NO: 619 conjugated to Formula VI at 3' end and a modified antisense strand of SEQ ID NO: 546.

In some embodiments, the RNAi agent has a modified sense strand of SEQ ID NO: 620 conjugated to Formula VI at 3' end. In some embodiments, the RNAi agent has a modified antisense strand of SEQ ID NO: 547. In some embodiments, the RNAi agent has a modified sense strand of SEQ ID NO: 620 conjugated to Formula VI at 3' end and a modified antisense strand of SEQ ID NO: 547.

In some embodiments, the RNAi agent has a modified sense strand of SEQ ID NO: 621 conjugated to Formula VI at 3' end. In some embodiments, the RNAi agent has a modified antisense strand of SEQ ID NO: 548. In some embodiments, the RNAi agent has a modified sense strand of SEQ ID NO: 621 conjugated to Formula VI at 3' end and a modified antisense strand of SEQ ID NO: 548.

In some embodiments, the RNAi agent has a modified sense strand of SEQ ID NO: 622 conjugated to Formula VI at 3' end. In some embodiments, the RNAi agent has a modified antisense strand of SEQ ID NO: 549. In some embodiments, the RNAi agent has a modified sense strand of SEQ ID NO: 622 conjugated to Formula VI at 3' end and a modified antisense strand of SEQ ID NO: 549.

In some embodiments, the RNAi agent has a modified sense strand of SEQ ID NO: 623 conjugated to Formula VI at 3' end. In some embodiments, the RNAi agent has a modified antisense strand of SEQ ID NO: 550. In some embodiments, the RNAi agent has a modified sense strand of SEQ ID NO: 623 conjugated to Formula VI at 3' end and a modified antisense strand of SEQ ID NO: 550.

In some embodiments, the RNAi agent has a modified sense strand of SEQ ID NO: 624 conjugated to Formula VI at 3' end. In some embodiments, the RNAi agent has a modified antisense strand of SEQ ID NO: 551. In some embodiments, the RNAi agent has a modified sense strand of SEQ ID NO: 624 conjugated to Formula VI at 3' end and a modified antisense strand of SEQ ID NO: 551.

In some embodiments, the RNAi agent has a modified sense strand of SEQ ID NO: 625 conjugated to Formula VI at 3' end. In some embodiments, the RNAi agent has a modified antisense strand of SEQ ID NO: 552. In some embodiments, the RNAi agent has a modified sense strand of SEQ ID NO: 625 conjugated to Formula VI at 3' end and a modified antisense strand of SEQ ID NO: 552.

In some embodiments, the RNAi agent has a modified sense strand of SEQ ID NO: 626 conjugated to Formula VI at 3' end. In some embodiments, the RNAi agent has a modified antisense strand of SEQ ID NO: 553. In some embodiments, the RNAi agent has a modified sense strand of SEQ ID NO: 626 conjugated to Formula VI at 3' end and a modified antisense strand of SEQ ID NO: 553.

In some embodiments, the RNAi agent has a modified sense strand of SEQ ID NO: 627 conjugated to Formula VI at 3' end. In some embodiments, the RNAi agent has a modified antisense strand of SEQ ID NO: 554. In some embodiments, the RNAi agent has a modified sense strand of SEQ ID NO: 627 conjugated to Formula VI at 3' end and a modified antisense strand of SEQ ID NO: 554.

In some embodiments, the RNAi agent has a modified sense strand of SEQ ID NO: 628 conjugated to Formula VI at 3' end. In some embodiments, the RNAi agent has a modified antisense strand of SEQ ID NO: 555. In some embodiments, the RNAi agent has a modified sense strand of SEQ ID NO: 628 conjugated to Formula VI at 3' end and a modified antisense strand of SEQ ID NO: 555.

In some embodiments, the RNAi agent has a modified sense strand of SEQ ID NO: 629 conjugated to Formula VI at 3' end. In some embodiments, the RNAi agent has a modified antisense strand of SEQ ID NO: 5526. In some embodiments, the RNAi agent has a modified sense strand of SEQ ID NO: 629 conjugated to Formula VI at 3' end and a modified antisense strand of SEQ ID NO: 556.

In some embodiments, the RNAi agent has a modified sense strand of SEQ ID NO: 630 conjugated to Formula VI at 3' end. In some embodiments, the RNAi agent has a modified antisense strand of SEQ ID NO: 557. In some embodiments, the RNAi agent has a modified sense strand of SEQ ID NO: 630 conjugated to Formula VI at 3' end and a modified antisense strand of SEQ ID NO: 557.

In some embodiments, the RNAi agent has a modified sense strand of SEQ ID NO: 631 conjugated to Formula VI at 3' end. In some embodiments, the RNAi agent has a modified antisense strand of SEQ ID NO: 558. In some embodiments, the RNAi agent has a modified sense strand of SEQ ID NO: 631 conjugated to Formula VI at 3' end and a modified antisense strand of SEQ ID NO: 558.

In some embodiments, the RNAi agent has a modified sense strand of SEQ ID NO: 632 conjugated to Formula VI at 3' end. In some embodiments, the RNAi agent has a modified antisense strand of SEQ ID NO: 559. In some embodiments, the RNAi agent has a modified sense strand of SEQ ID NO: 632 conjugated to Formula VI at 3' end and a modified antisense strand of SEQ ID NO: 559.

In some embodiments, the RNAi agent has a modified sense strand of SEQ ID NO: 633 conjugated to Formula VI at 3' end. In some embodiments, the RNAi agent has a modified antisense strand of SEQ ID NO: 560. In some embodiments, the RNAi agent has a modified sense strand of SEQ ID NO: 633 conjugated to Formula VI at 3' end and a modified antisense strand of SEQ ID NO: 560.

In some embodiments, the RNAi agent has a modified sense strand of SEQ ID NO: 634 conjugated to Formula VI at 3' end. In some embodiments, the RNAi agent has a modified antisense strand of SEQ ID NO: 561. In some embodiments, the RNAi agent has a modified sense strand of SEQ ID NO: 634 conjugated to Formula VI at 3' end and a modified antisense strand of SEQ ID NO: 561.

In some embodiments, the RNAi agent has a modified sense strand of SEQ ID NO: 635 conjugated to Formula VI at 3' end. In some embodiments, the RNAi agent has a modified antisense strand of SEQ ID NO: 562. In some embodiments, the RNAi agent has a modified sense strand of SEQ ID NO: 635 conjugated to Formula VI at 3' end and a modified antisense strand of SEQ ID NO: 562.

In some embodiments, the RNAi agent has a modified sense strand of SEQ ID NO: 636 conjugated to Formula VI at 3' end. In some embodiments, the RNAi agent has a modified antisense strand of SEQ ID NO: 563. In some embodiments, the RNAi agent has a modified sense strand of SEQ ID NO: 636 conjugated to Formula VI at 3' end and a modified antisense strand of SEQ ID NO: 563.

In some embodiments, the RNAi agent has a modified sense strand of SEQ ID NO: 637 conjugated to Formula VI at 3' end. In some embodiments, the RNAi agent has a modified antisense strand of SEQ ID NO: 564. In some embodiments, the RNAi agent has a modified sense strand of SEQ ID NO: 637 conjugated to Formula VI at 3' end and a modified antisense strand of SEQ ID NO: 564.

In some embodiments, the RNAi agent has a modified sense strand of SEQ ID NO: 638 conjugated to Formula VI at 3' end. In some embodiments, the RNAi agent has a modified antisense strand of SEQ ID NO: 565. In some embodiments, the RNAi agent has a modified sense strand of SEQ ID NO: 638 conjugated to Formula VI at 3' end and a modified antisense strand of SEQ ID NO: 565.

In some embodiments, the RNAi agent has a modified sense strand of SEQ ID NO: 639 conjugated to Formula VI at 3' end. In some embodiments, the RNAi agent has a modified antisense strand of SEQ ID NO: 566. In some embodiments, the RNAi agent has a modified sense strand of SEQ ID NO: 639 conjugated to Formula VI at 3' end and a modified antisense strand of SEQ ID NO: 566.

In some embodiments, the RNAi agent has a modified sense strand of SEQ ID NO: 640 conjugated to Formula VI at 3' end. In some embodiments, the RNAi agent has a modified antisense strand of SEQ ID NO: 567. In some embodiments, the RNAi agent has a modified sense strand of SEQ ID NO: 640 conjugated to Formula VI at 3' end and a modified antisense strand of SEQ ID NO: 567.

In some embodiments, the RNAi agent has a modified sense strand of SEQ ID NO: 641 conjugated to Formula VI at 3' end. In some embodiments, the RNAi agent has a modified antisense strand of SEQ ID NO: 568. In some embodiments, the RNAi agent has a modified sense strand of SEQ ID NO: 641 conjugated to Formula VI at 3' end and a modified antisense strand of SEQ ID NO: 568.

In some embodiments, the RNAi agent has a modified sense strand of SEQ ID NO: 642 conjugated to Formula VI at 3' end. In some embodiments, the RNAi agent has a modified antisense strand of SEQ ID NO: 569. In some embodiments, the RNAi agent has a modified sense strand of SEQ ID NO: 642 conjugated to Formula VI at 3' end and a modified antisense strand of SEQ ID NO: 569.

In some embodiments, the RNAi agent has a modified sense strand of SEQ ID NO: 643 conjugated to Formula VI at 3' end. In some embodiments, the RNAi agent has a modified antisense strand of SEQ ID NO: 570. In some embodiments, the RNAi agent has a modified sense strand of SEQ ID NO: 643 conjugated to Formula VI at 3' end and a modified antisense strand of SEQ ID NO: 570.

In some embodiments, the RNAi agent has a modified sense strand of SEQ ID NO: 644 conjugated to Formula VI at 3' end. In some embodiments, the RNAi agent has a modified antisense strand of SEQ ID NO: 571. In some embodiments, the RNAi agent has a modified sense strand of SEQ ID NO: 644 conjugated to Formula VI at 3' end and a modified antisense strand of SEQ ID NO: 571.

In some embodiments, the RNAi agent has a modified sense strand of SEQ ID NO: 645 conjugated to Formula VI at 3' end. In some embodiments, the RNAi agent has a modified antisense strand of SEQ ID NO: 572. In some embodiments, the RNAi agent has a modified sense strand of SEQ ID NO: 645 conjugated to Formula VI at 3' end and a modified antisense strand of SEQ ID NO: 572.

In some embodiments, the RNAi agent has a modified sense strand of SEQ ID NO: 646 conjugated to Formula VI at 3' end. In some embodiments, the RNAi agent has a modified antisense strand of SEQ ID NO: 573. In some embodiments, the RNAi agent has a modified sense strand of SEQ ID NO: 646 conjugated to Formula VI at 3' end and a modified antisense strand of SEQ ID NO: 573.

In some embodiments, the RNAi agent has a modified sense strand of SEQ ID NO: 647 conjugated to Formula VI at 3' end. In some embodiments, the RNAi agent has a modified antisense strand of SEQ ID NO: 574. In some embodiments, the RNAi agent has a modified sense strand of SEQ ID NO: 647 conjugated to Formula VI at 3' end and a modified antisense strand of SEQ ID NO: 574.

In some embodiments, the RNAi agent has a modified sense strand of SEQ ID NO: 648 conjugated to Formula VI at 3' end. In some embodiments, the RNAi agent has a modified antisense strand of SEQ ID NO: 575. In some embodiments, the RNAi agent has a modified sense strand of SEQ ID NO: 648 conjugated to Formula VI at 3' end and a modified antisense strand of SEQ ID NO: 575.

In some embodiments, the RNAi agent has a modified sense strand of SEQ ID NO: 649 conjugated to Formula VI at 3' end. In some embodiments, the RNAi agent has a modified antisense strand of SEQ ID NO: 576. In some embodiments, the RNAi agent has a modified sense strand of SEQ ID NO: 649 conjugated to Formula VI at 3' end and a modified antisense strand of SEQ ID NO: 576.

In some embodiments, the RNAi agent has a modified sense strand of SEQ ID NO: 650 conjugated to Formula VI at 3' end. In some embodiments, the RNAi agent has a modified antisense strand of SEQ ID NO: 577. In some embodiments, the RNAi agent has a modified sense strand of SEQ ID NO: 650 conjugated to Formula VI at 3' end and a modified antisense strand of SEQ ID NO: 577.

In some embodiments, the RNAi agent has a modified sense strand of SEQ ID NO: 651 conjugated to Formula VI at 3' end. In some embodiments, the RNAi agent has a modified antisense strand of SEQ ID NO: 578. In some embodiments, the RNAi agent has a modified sense strand of SEQ ID NO: 651 conjugated to Formula VI at 3' end and a modified antisense strand of SEQ ID NO: 578.

In some embodiments, the RNAi agent has a modified sense strand of SEQ ID NO: 652 conjugated to Formula VI at 3' end. In some embodiments, the RNAi agent has a modified antisense strand of SEQ ID NO: 579. In some embodiments, the RNAi agent has a modified sense strand of SEQ ID NO: 652 conjugated to Formula VI at 3' end and a modified antisense strand of SEQ ID NO: 579.

In some embodiments, the RNAi agent has a modified sense strand of SEQ ID NO: 653 conjugated to Formula VI at 3' end. In some embodiments, the RNAi agent has a modified antisense strand of SEQ ID NO: 580. In some embodiments, the RNAi agent has a modified sense strand of SEQ ID NO: 653 conjugated to Formula VI at 3' end and a modified antisense strand of SEQ ID NO: 580.

In some embodiments, the RNAi agent has a modified sense strand of SEQ ID NO: 654 conjugated to Formula VI at 3' end. In some embodiments, the RNAi agent has a modified antisense strand of SEQ ID NO: 581. In some embodiments, the RNAi agent has a modified sense strand of SEQ ID NO: 654 conjugated to Formula VI at 3' end and a modified antisense strand of SEQ ID NO: 581.

In some embodiments, the RNAi agent has a modified sense strand of SEQ ID NO: 655 conjugated to Formula VI at 3' end. In some embodiments, the RNAi agent has a modified antisense strand of SEQ ID NO: 581. In some embodiments, the RNAi agent has a modified sense strand of SEQ ID NO: 655 conjugated to Formula VI at 3' end and a modified antisense strand of SEQ ID NO: 581.

In some embodiments, the RNAi agent has a modified sense strand of SEQ ID NO: 656 conjugated to Formula VI at 3' end. In some embodiments, the RNAi agent has a modified antisense strand of SEQ ID NO: 583. In some embodiments, the RNAi agent has a modified sense strand of SEQ ID NO: 656 conjugated to Formula VI at 3' end and a modified antisense strand of SEQ ID NO: 583.

In some embodiments, the RNAi agent has a modified sense strand of SEQ ID NO: 657 conjugated to Formula VI at 3' end. In some embodiments, the RNAi agent has a modified antisense strand of SEQ ID NO: 584. In some embodiments, the RNAi agent has a modified sense strand of SEQ ID NO: 657 conjugated to Formula VI at 3' end and a modified antisense strand of SEQ ID NO: 584.

In some embodiments, the RNAi agent has a modified sense strand of SEQ ID NO: 658 conjugated to Formula VI at 3' end. In some embodiments, the RNAi agent has a modified antisense strand of SEQ ID NO: 585. In some embodiments, the RNAi agent has a modified sense strand of SEQ ID NO: 658 conjugated to Formula VI at 3' end and a modified antisense strand of SEQ ID NO: 585.

In some embodiments, the RNAi agent has a modified sense strand of SEQ ID NO: 659 conjugated to Formula VI at 3' end. In some embodiments, the RNAi agent has a modified antisense strand of SEQ ID NO: 586. In some embodiments, the RNAi agent has a modified sense strand of SEQ ID NO: 659 conjugated to Formula VI at 3' end and a modified antisense strand of SEQ ID NO: 586.

In some embodiments, the RNAi agent has a modified sense strand of SEQ ID NO: 660 conjugated to Formula VI at 3' end. In some embodiments, the RNAi agent has a modified antisense strand of SEQ ID NO: 587. In some embodiments, the RNAi agent has a modified sense strand of SEQ ID NO: 660 conjugated to Formula VI at 3' end and a modified antisense strand of SEQ ID NO: 587.

In some embodiments, the RNAi agent has a modified sense strand of SEQ ID NO: 661 conjugated to Formula VI at 3' end. In some embodiments, the RNAi agent has a modified antisense strand of SEQ ID NO: 588. In some embodiments, the RNAi agent has a modified sense strand of SEQ ID NO: 661 conjugated to Formula VI at 3' end and a modified antisense strand of SEQ ID NO: 588.

In some embodiments, the RNAi agent has a modified sense strand of SEQ ID NO: 662 conjugated to Formula VI at 3' end. In some embodiments, the RNAi agent has a modified antisense strand of SEQ ID NO: 589. In some embodiments, the RNAi agent has a modified sense strand of SEQ ID NO: 662 conjugated to Formula VI at 3' end and a modified antisense strand of SEQ ID NO: 589.

In some embodiments, the RNAi agent has a modified sense strand of SEQ ID NO: 663 conjugated to Formula VI at 3' end. In some embodiments, the RNAi agent has a modified antisense strand of SEQ ID NO: 590. In some embodiments, the RNAi agent has a modified sense strand of SEQ ID NO: 663 conjugated to Formula VI at 3' end and a modified antisense strand of SEQ ID NO: 590.

In some embodiments, the RNAi agent has a modified sense strand of SEQ ID NO: 664 conjugated to Formula VI at 3' end. In some embodiments, the RNAi agent has a modified antisense strand of SEQ ID NO: 591. In some embodiments, the RNAi agent has a modified sense strand of SEQ ID NO: 664 conjugated to Formula VI at 3' end and a modified antisense strand of SEQ ID NO: 591.

In some embodiments, the RNAi agent has a modified sense strand of SEQ ID NO: 665 conjugated to Formula VI at 3' end. In some embodiments, the RNAi agent has a modified antisense strand of SEQ ID NO: 592. In some embodiments, the RNAi agent has a modified sense strand of SEQ ID NO: 665 conjugated to Formula VI at 3' end and a modified antisense strand of SEQ ID NO: 592.

In some embodiments, the RNAi agent has a modified sense strand of SEQ ID NO: 666 conjugated to Formula VI at 3' end. In some embodiments, the RNAi agent has a modified antisense strand of SEQ ID NO: 593. In some embodiments, the RNAi agent has a modified sense strand of SEQ ID NO: 666 conjugated to Formula VI at 3' end and a modified antisense strand of SEQ ID NO: 593.

In some embodiments, the RNAi agent has a modified sense strand of SEQ ID NO: 667 conjugated to Formula VI at 3' end. In some embodiments, the RNAi agent has a modified antisense strand of SEQ ID NO: 594. In some embodiments, the RNAi agent has a modified sense strand of SEQ ID NO: 667 conjugated to Formula VI at 3' end and a modified antisense strand of SEQ ID NO: 594.

In some embodiments, the RNAi agent has a modified sense strand of SEQ ID NO: 668 conjugated to Formula VI at 3' end. In some embodiments, the RNAi agent has a modified antisense strand of SEQ ID NO: 595. In some embodiments, the RNAi agent has a modified sense strand of SEQ ID NO: 668 conjugated to Formula VI at 3' end and a modified antisense strand of SEQ ID NO: 595.

In some embodiments, the RNAi agent has a modified sense strand of SEQ ID NO: 669 conjugated to Formula VI at 3' end. In some embodiments, the RNAi agent has a modified antisense strand of SEQ ID NO: 596. In some embodiments, the RNAi agent has a modified sense strand of SEQ ID NO: 669 conjugated to Formula VI at 3' end and a modified antisense strand of SEQ ID NO: 596.

In some embodiments, the RNAi agent has a modified sense strand of SEQ ID NO: 670 conjugated to Formula VI at 3' end. In some embodiments, the RNAi agent has a modified antisense strand of SEQ ID NO: 597. In some embodiments, the RNAi agent has a modified sense strand of SEQ ID NO: 670 conjugated to Formula VI at 3' end and a modified antisense strand of SEQ ID NO: 597.

In some embodiments, the RNAi agent has a modified sense strand of SEQ ID NO: 671 conjugated to Formula VI at 3' end. In some embodiments, the RNAi agent has a modified antisense strand of SEQ ID NO: 598. In some embodiments, the RNAi agent has a modified sense strand of SEQ ID NO: 671 conjugated to Formula VI at 3' end and a modified antisense strand of SEQ ID NO: 598.

In some embodiments, the RNAi agent has a modified sense strand of SEQ ID NO: 672 conjugated to Formula VI at 3' end. In some embodiments, the RNAi agent has a modified antisense strand of SEQ ID NO: 599. In some embodiments, the RNAi agent has a modified sense strand of SEQ ID NO: 672 conjugated to Formula VI at 3' end and a modified antisense strand of SEQ ID NO: 599.

In some embodiments, the RNAi agent has a modified sense strand of SEQ ID NO: 673 conjugated to Formula VI at 3' end. In some embodiments, the RNAi agent has a modified antisense strand of SEQ ID NO: 600. In some embodiments, the RNAi agent has a modified sense strand of SEQ ID NO: 673 conjugated to Formula VI at 3' end and a modified antisense strand of SEQ ID NO: 600.

In some embodiments, the RNAi agent has a modified sense strand of SEQ ID NO: 674 conjugated to Formula VI at 3' end. In some embodiments, the RNAi agent has a modified antisense strand of SEQ ID NO: 601. In some embodiments, the RNAi agent has a modified sense strand of SEQ ID NO: 674 conjugated to Formula VI at 3' end and a modified antisense strand of SEQ ID NO: 601.

In some embodiments, the RNAi agent has a modified sense strand of SEQ ID NO: 675 conjugated to Formula VI at 3' end. In some embodiments, the RNAi agent has a modified antisense strand of SEQ ID NO: 602. In some embodiments, the RNAi agent has a modified sense strand of SEQ ID NO: 675 conjugated to Formula VI at 3' end and a modified antisense strand of SEQ ID NO: 602.

In some embodiments, the RNAi agent has a modified sense strand of SEQ ID NO: 676 conjugated to Formula VI at 3' end. In some embodiments, the RNAi agent has a modified antisense strand of SEQ ID NO: 603. In some embodiments, the RNAi agent has a modified sense strand of SEQ ID NO: 676 conjugated to Formula VI at 3' end and a modified antisense strand of SEQ ID NO: 603.

In some embodiments, the RNAi agent has a modified sense strand of SEQ ID NO: 713 conjugated to Formula VI at 3' end. In some embodiments, the RNAi agent has a modified antisense strand of SEQ ID NO: 701. In some embodiments, the RNAi agent has a modified sense strand of SEQ ID NO: 713 conjugated to Formula VI at 3' end and a modified antisense strand of SEQ ID NO: 701.

In some embodiments, the RNAi agent has a modified sense strand of SEQ ID NO: 714 conjugated to Formula VI at 3' end. In some embodiments, the RNAi agent has a modified antisense strand of SEQ ID NO: 702. In some embodiments, the RNAi agent has a modified sense strand of SEQ ID NO: 714 conjugated to Formula VI at 3' end and a modified antisense strand of SEQ ID NO: 702.

In some embodiments, the RNAi agent has a modified sense strand of SEQ ID NO: 715 conjugated to Formula VI at 3' end. In some embodiments, the RNAi agent has a modified antisense strand of SEQ ID NO: 703. In some embodiments, the RNAi agent has a modified sense strand of SEQ ID NO: 715 conjugated to Formula VI at 3' end and a modified antisense strand of SEQ ID NO: 703.

In some embodiments, the RNAi agent has a modified sense strand of SEQ ID NO: 716 conjugated to Formula VI at 3' end. In some embodiments, the RNAi agent has a modified antisense strand of SEQ ID NO: 704. In some embodiments, the RNAi agent has a modified sense strand of SEQ ID NO: 716 conjugated to Formula VI at 3' end and a modified antisense strand of SEQ ID NO: 704.

In some embodiments, the RNAi agent has a modified sense strand of SEQ ID NO: 717 conjugated to Formula VI at 3' end. In some embodiments, the RNAi agent has a modified antisense strand of SEQ ID NO: 705. In some embodiments, the RNAi agent has a modified sense strand of SEQ ID NO: 717 conjugated to Formula VI at 3' end and a modified antisense strand of SEQ ID NO: 705.

In some embodiments, the RNAi agent has a modified sense strand of SEQ ID NO: 718 conjugated to Formula VI at 3' end. In some embodiments, the RNAi agent has a modified antisense strand of SEQ ID NO: 706. In some embodiments, the RNAi agent has a modified sense strand of SEQ ID NO: 718 conjugated to Formula VI at 3' end and a modified antisense strand of SEQ ID NO: 706.

In some embodiments, the RNAi agent has a modified sense strand of SEQ ID NO: 719 conjugated to Formula VI at 3' end. In some embodiments, the RNAi agent has a modified antisense strand of SEQ ID NO: 707. In some embodiments, the RNAi agent has a modified sense strand of SEQ ID NO: 719 conjugated to Formula VI at 3' end and a modified antisense strand of SEQ ID NO: 707.

In some embodiments, the RNAi agent has a modified sense strand of SEQ ID NO: 720 conjugated to Formula VI at 3' end. In some embodiments, the RNAi agent has a modified antisense strand of SEQ ID NO: 708. In some embodiments, the RNAi agent has a modified sense strand of SEQ ID NO: 720 conjugated to Formula VI at 3' end and a modified antisense strand of SEQ ID NO: 708.

In some embodiments, the RNAi agent has a modified sense strand of SEQ ID NO: 721 conjugated to Formula VI at 3' end. In some embodiments, the RNAi agent has a modified antisense strand of SEQ ID NO: 709. In some embodiments, the RNAi agent has a modified sense strand of SEQ ID NO: 721 conjugated to Formula VI at 3' end and a modified antisense strand of SEQ ID NO: 709.

In some embodiments, the RNAi agent has a modified sense strand of SEQ ID NO: 722 conjugated to Formula VI at 3' end. In some embodiments, the RNAi agent has a modified antisense strand of SEQ ID NO: 710. In some embodiments, the RNAi agent has a modified sense strand of SEQ ID NO: 722 conjugated to Formula VI at 3' end and a modified antisense strand of SEQ ID NO: 710.

In some embodiments, the RNAi agent has a modified sense strand of SEQ ID NO: 723 conjugated to Formula VI at 3' end. In some embodiments, the RNAi agent has a modified antisense strand of SEQ ID NO: 711. In some embodiments, the RNAi agent has a modified sense strand of SEQ ID NO: 723 conjugated to Formula VI at 3' end and a modified antisense strand of SEQ ID NO: 711.

In some embodiments, the RNAi agent has a modified sense strand of SEQ ID NO: 724 conjugated to Formula VI at 3' end. In some embodiments, the RNAi agent has a modified antisense strand of SEQ ID NO: 712. In some embodiments, the RNAi agent has a modified sense strand of SEQ ID NO: 724 conjugated to Formula VI at 3' end and a modified antisense strand of SEQ ID NO: 712.

In some embodiments, the RNAi agent has a modified sense strand of SEQ ID NO: 726 conjugated to Formula VI at 3' end. In some embodiments, the RNAi agent has a modified antisense strand of SEQ ID NO: 603. In some embodiments, the RNAi agent has a modified sense strand of SEQ ID NO: 726 conjugated to Formula VI at 3' end and a modified antisense strand of SEQ ID NO: 603.

In some embodiments, the RNAi agent has a modified sense strand of SEQ ID NO: 727 conjugated to Formula VI at 3' end. In some embodiments, the RNAi agent has a modified antisense strand of SEQ ID NO: 596. In some embodiments, the RNAi agent has a modified sense strand of SEQ ID NO: 727 conjugated to Formula VI at 3' end and a modified antisense strand of SEQ ID NO: 596.

In some embodiments, the RNAi agent has a modified sense strand of SEQ ID NO: 728 conjugated to Formula VI at 3' end. In some embodiments, the RNAi agent has a modified antisense strand of SEQ ID NO: 728. In some embodiments, the RNAi agent has a modified sense strand of SEQ ID NO: 703 conjugated to Formula VI at 3' end and a modified antisense strand of SEQ ID NO: 703.

In some embodiments, the RNAi agent has a modified sense strand of SEQ ID NO: 729 conjugated to Formula VI at 3' end. In some embodiments, the RNAi agent has a modified antisense strand of SEQ ID NO: 701. In some embodiments, the RNAi agent has a modified sense strand of SEQ ID NO: 729 conjugated to Formula VI at 3' end and a modified antisense strand of SEQ ID NO: 701.

In some embodiments, the RNAi agent has a modified sense strand of SEQ ID NO: 730 conjugated to Formula VI at 3' end. In some embodiments, the RNAi agent has a modified antisense strand of SEQ ID NO: 595. In some embodiments, the RNAi agent has a modified sense strand of SEQ ID NO: 730 conjugated to Formula VI at 3' end and a modified antisense strand of SEQ ID NO: 595.

In some embodiments, the RNAi agent has a modified sense strand of SEQ ID NO: 731 conjugated to Formula VI at 3' end. In some embodiments, the RNAi agent has a modified antisense strand of SEQ ID NO: 704. In some embodiments, the RNAi agent has a modified sense strand of SEQ ID NO: 731 conjugated to Formula VI at 3' end and a modified antisense strand of SEQ ID NO: 704.

III. PHARMACEUTICAL COMPOSITIONS

Also provided are compositions including the RNAi agent, including pharmaceutical compositions and formulations. In some embodiments, provided herein is a pharmaceutical composition comprising any one of the RNAi agents provided herein, any one of the modified oligonucleotides provided herein, or any one of the oligomeric duplexes provided herein. The pharmaceutical compositions and formulations generally include one or more optional pharmaceutically acceptable carrier(s) or excipient(s). In some embodiments, provided herein is a pharmaceutical composition comprising any one of the RNAi agents provided herein, any one of the modified oligonucleotides provided herein, or any one of the oligomeric duplexes provided herein, and a pharmaceutically acceptable carrier. In some embodiments, the composition includes at least one additional therapeutic agent.

The term "pharmaceutical formulation" refers to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative.

In some aspects, the choice of carrier is determined in part by the method of administration. Accordingly, there are a variety of suitable formulations. For example, the pharmaceutical composition can contain preservatives. Suitable preservatives may include, for example, methylparaben, propylparaben, sodium benzoate, and benzalkonium chloride. In some aspects, a mixture of two or more preservatives is used. The preservative or mixtures thereof are typically present in an amount of about 0.0001% to about 2% by weight of the total composition. Carriers are described, e.g., by Remington's Pharmaceutical Sciences 16th edition, Osol, A. Ed. (1980). Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG).

Buffering agents in some aspects are included in the compositions. Suitable buffering agents include, for example, citric acid, sodium citrate, phosphoric acid, potassium phosphate, and various other acids and salts. In some aspects, a mixture of two or more buffering agents is used. The buffering agent or mixtures thereof are typically present in an amount of about 0.001% to about 4% by weight of the total composition. Methods for preparing administrable pharmaceutical compositions are known. Exemplary methods are described in more detail in, for example, Remington:

The Science and Practice of Pharmacy, Lippincott Williams & Wilkins; 21st ed. (May 1, 2005).

The formulation or composition may also contain more than one active ingredient useful for the particular indication, disease, or condition being treated with the RNAI agent, preferably those with activities complementary to the binding molecule or cell, where the respective activities do not adversely affect one another. Such active ingredients are suitably present in combination in amounts that are effective for the purpose intended. Thus, in some embodiments, the pharmaceutical composition further includes other pharmaceutically active agents or drugs.

In some embodiments, a delivery vehicle may be used to deliver an RNAi agent to a cell or tissue. A delivery vehicle is a compound that improves delivery of the RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine.

In some embodiments, the RNAi agents, modified oligonucleotides, and oligomeric duplexes can be combined with lipids, nanoparticles, polymers, liposomes, micelles, DPCs or other delivery systems available in the art. The RNAi agents can also be chemically conjugated to targeting groups, lipids (including, but not limited to cholesterol and cholesteryl derivatives), nanoparticles, polymers, liposomes, micelles, DPCs (see, for example WO 2000/053722, WO 2008/0022309, WO 2011/104169, and WO 2012/083185, WO 2013/032829, WO 2013/158141, each of which is incorporated herein by reference), or other delivery systems available in the art. Additional lipid particle formulations are described in U.S. Pat. No. 10,683,501, which is incorporated herein by reference.

Active ingredients may be entrapped in microcapsules, in colloidal drug delivery systems (for example, liposomes, albumin microspheres, microemulsions, nano-particles and nanocapsules) or in macroemulsions. In certain embodiments, the pharmaceutical composition is formulated as an inclusion complex, such as cyclodextrin inclusion complex, or as a liposome. Liposomes can serve to target the host cells (e.g., T-cells or NK cells) to a particular tissue. Many methods are available for preparing liposomes, such as those described in, for example, Szoka et al., Ann. Rev. Biophys. Bioeng, 9:467 (1980), and U.S. Pat. Nos. 4,235,871, 4,501,728, 4,837,028, and 5,019,369.

In some embodiments, the RNAi agents, modified oligonucleotides, and oligomeric duplexes may be fully encapsulated in a lipid formulation, e.g., a LNP, or other nucleic acid-lipid particle. As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; U.S. Publication No. 2010/0324120 and PCT Publication No. WO 96/4096.

In some embodiments, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N,N-dimethylammonium bromide (DDAB), N—(I-(2,3-dioleoyloxy) propyl)-N,N,N-trimethylammonium chloride (DOTAP), N—(I-(2,3-dioleyloxy) propyl)-N,N,N-trimethylammonium chloride (DOTMA), N,N-dimethyl-2,3-dioleyloxy) propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino) acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA·Cl), 1,2-Dilinoleoyl-3-trimethylaminopropane chloride salt (DLin-TAP·Cl), 1,2-Dilinoleyloxy-3-(N-methylpiperazino) propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino) ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino) butanoate (MC3), 1,1'-(2-(4-(2-((2-(bis (2-hydroxydodecyl)amino)ethyl) (2-hydroxydodecyl) amino)ethyl) piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In some embodiments, the compound 2,2-Dilinoleyl-4-dimethylaminoethyl-[1,3]-dioxolane can be used to prepare lipid-siRNA nanoparticles. Synthesis of 2,2-Dilinoleyl-4-dimethylaminoethyl-[1,3]-dioxolane is described in U.S. provisional patent application No. 61/107,998 filed on Oct. 23, 2008, which is herein incorporated by reference. In some embodiments, the lipid-siRNA particle includes 40% 2,2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)- cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($Ci_2$), a PEG-dimyristyloxypropyl ($Ci_4$), a PEG-dipalmityloxypropyl ($Ci_6$), or a PEG-distearyloxypropyl ($C]_8$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In some embodiments, the lipidoid ND98.4HCl (MW 1487) (see U.S. patent application Ser. No. 12/056,230, filed Mar. 26, 2008, which is incorporated herein by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

In some embodiments, provided herein is a lipid nanoparticle (such as any of the lipid nanoparticles described herein) comprising any one of the RNAi agents described herein, any one of the modified oligonucleotides described herein, any one of the oligomeric duplexes described herein, or any one of the pharmaceutical compositions described herein.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

The pharmaceutical composition in some embodiments contains the RNAi agent in amounts effective to treat or prevent the disease or condition, such as a therapeutically effective or prophylactically effective amount. Therapeutic or prophylactic efficacy in some embodiments is monitored by periodic assessment of treated subjects. For repeated administrations over several days or longer, depending on the condition, the treatment is repeated until a desired suppression of disease symptoms occurs. However, other dosage regimens may be useful and can be determined. The desired dosage can be delivered by a single bolus administration of the composition, by multiple bolus administrations of the composition, or by continuous infusion administration of the composition.

The pharmaceutical composition may be administered using standard administration techniques, formulations, and/or devices. Provided are formulations and devices, such as syringes and vials, for storage and administration of the compositions. Formulations include those for oral, intravenous, intraperitoneal, subcutaneous, pulmonary, transdermal, intramuscular, intranasal, buccal, sublingual, or suppository administration. In some embodiments, the cell populations are administered parenterally. The term "parenteral," as used herein, includes intravenous, intramuscular, subcutaneous, rectal, vaginal, intracranial, intrathoracic, and intraperitoneal administration.

Compositions in some embodiments are provided as sterile liquid preparations, e.g., isotonic aqueous solutions, suspensions, emulsions, dispersions, or viscous compositions, which may in some aspects be buffered to a selected pH. Liquid preparations are normally easier to prepare than gels, other viscous compositions, and solid compositions. Additionally, liquid compositions are somewhat more convenient to administer, especially by injection. Viscous compositions, on the other hand, can be formulated within the appropriate viscosity range to provide longer contact periods with specific tissues. Liquid or viscous compositions can comprise carriers, which can be a solvent or dispersing medium containing, for example, water, saline, phosphate buffered saline, polyol (for example, glycerol, propylene glycol, liquid polyethylene glycol) and suitable mixtures thereof.

Sterile injectable solutions can be prepared by incorporating the RNAi in a solvent, such as in admixture with a suitable carrier, diluent, or excipient such as sterile water, physiological saline, glucose, dextrose, or the like. The compositions can also be lyophilized. The compositions can contain auxiliary substances such as wetting, dispersing, or emulsifying agents (e.g., methylcellulose), pH buffering agents, gelling or viscosity enhancing additives, preservatives, flavoring agents, colors, and the like, depending upon the route of administration and the preparation desired. Standard texts may in some aspects be consulted to prepare suitable preparations.

Various additives which enhance the stability and sterility of the compositions, including antimicrobial preservatives, antioxidants, chelating agents, and buffers, can be added. Prevention of the action of microorganisms can be ensured by various antibacterial and antifungal agents, for example, parabens, chlorobutanol, phenol, sorbic acid, and the like. Prolonged absorption of the injectable pharmaceutical form can be brought about by the use of agents delaying absorption, for example, aluminum monostearate and gelatin.

The formulations to be used for in vivo administration are generally sterile. Sterility may be readily accomplished, e.g., by filtration through sterile filtration membranes.

In some embodiments, pharmaceutical compositions for delivering an RNAi agent (e.g. an IRS1 RNAi) to a liver cell in vivo are described. Such pharmaceutical compositions can include, for example, an RNAi agent (e.g. an IRS1 RNAi) conjugated to a galactose derivative cluster. In some embodiments, the galactose derivative cluster is comprised of a galactose derivative trimer, which can be, for example, an N-acetyl-galactosamine trimer, or galactose derivative tetramer, which can be, for example, an N-acetyl-galactosamine tetramer.

The present disclosure also provides methods of making a pharmaceutical composition, such as any of the pharmaceutical compositions described herein. In some aspects, provided herein is a method of making a pharmaceutical composition, comprising combining any one of the RNAi agents described herein, any one of the modified oligonucleotides described herein, or any one of the oligomeric duplexes described herein, with a delivery vehicle. In some embodiments, the delivery vehicle is a delivery vehicle selected from the group consisting of a phosphate-buffered saline (PBS), lipid, a nanoparticle, a polymer, a liposome, a micelle, a dynamic polyconjugate (DPC), or an antibody-oligo conjugate.

IV. USES AND METHODS

Also provided herein are methods of administering and uses of, such as therapeutic and prophylactic uses of, the RNAi agent (e.g., IRS1 RNAi) and/or compositions comprising the same. Such methods and uses include therapeutic methods and uses, for example, involving administration of the RNAi (e.g., IRS1 RNAi) or compositions containing the same, to a subject having a disease, condition, or disorder associated with IRS1 such as a disease, condition, or disorder associated with IRS1 expression, and/or in which cells or tissues express, e.g., specifically express, IRS1.

In some embodiments, the RNAi agent and/or composition is administered in an effective amount to effect treatment of the disease or disorder. Provided herein are uses of the RNAi agent in such methods and treatments, and in the preparation of a medicament in order to carry out such therapeutic methods. In some embodiments, the methods are carried out by administering the RNAi agent or compositions comprising the same, to the subject having, having had, or suspected of having the disease or condition. In some embodiments, the methods thereby treat the disease or condition or disorder in the subject. Also provided herein are use of any of the compositions, such as pharmaceutical compositions provided herein, for the treatment of a disease or disorder associated with IRS1, such as use in a treatment regimen. Also provided herein are use of any of the compositions, such as pharmaceutical compositions provided herein, for the treatment of nonalcoholic fatty liver disease (NAFLD) and/or nonalcoholic steatohepatitis (NASH), such as use in a treatment regimen. Also provided herein are uses of any of the compositions, such as pharmaceutical compositions, for reducing, stopping progression of, or slowing progression of NAFLD, NASH, steatosis, fibrosis, and/or cirrhosis.

The disease, condition, or disorder that is detected and diagnosed by the RNAi agent disclosed herein can be any in which expression of an antigen is associated with and/or involved in the etiology of a disease condition or disorder, e.g. causes, exacerbates or otherwise is involved in such disease, condition, or disorder. Exemplary diseases and conditions can include diseases or conditions associated with malignancy or transformation of cells (e.g., cancer), autoimmune or inflammatory disease, or an infectious disease, e.g., caused by a bacterial, viral or other pathogen.

In some embodiments, the disease, disorder, or condition is an infectious disease such as infection with a virus or other pathogen, e.g., HIV, HCV, HBV, CMV, HPV, and parasitic disease.

In some embodiments, the disease, disorder, or condition is a liver disease. In certain embodiments, the liver disease includes, but is not limited to, simple fatty liver (steatosis), non-alcoholic steatohepatitis (NASH), fibrosis, and cirrhosis.

Among the disease, disorder, or condition to be treated is any disease or disorder associated with nonalcoholic fatty liver disease. Among the disease, disorder, or condition to be treated is any disease or disorder associated with IRS1 or any disease or disorder in which IRS1 is specifically expressed and/or in which IRS1 has been targeted for treatment. Insulin receptor substrate 1 (IRS1) is a major substrate for the insulin receptor and other tyrosine kinases. IRS1 plays a key role in eliciting many of insulin's actions, including binding and activation of phosphatidylinositol (PI) 3-kinase and the subsequent increase in glucose transport. In some embodiments, the disease or disorder is non-alcoholic fatty liver disease (NAFLD). In some embodiments, the disease or disorder is non-alcoholic fatty liver. In some embodiments, the disease or disorder is nonalcoholic steatohepatitis (NASH). In some embodiments, the disease or disorder is metabolic dysfunction-associated steatotic liver disease (MASLD). In some embodiments, the disease or disorder is metabolic dysfunction-associated steatohepatitis (MASH).

In some embodiments, provided herein is a method of treating NAFLD or NASH in a subject, comprising administering to the subject an effective amount of a liver-targeted modified oligonucleotide, a liver-targeted oligomeric duplex, or a liver-targeted RNAi agent that inhibits expression of IRS1. In some embodiments, the liver-targeted modified oligonucleotide, the liver-targeted oligomeric duplex, and the liver-targeted RNAi agent is any one of the modified oligonucleotides, oligomeric duplexes, or RNAi agents described herein. In some embodiments, provided herein is a method of treating MASLD or MASH in a subject, comprising administering to the subject an effective amount of a liver-targeted modified oligonucleotide, a liver-targeted oligomeric duplex, or a liver-targeted RNAi agent that inhibits expression of IRS1. In some embodiments, the liver-targeted modified oligonucleotide, the liver-targeted oligomeric duplex, and the liver-targeted RNAi agent is any one of the modified oligonucleotides, oligomeric duplexes, or RNAi agents described herein.

In some embodiments, the RNAi (e.g., IRS1 RNAi) or compositions containing the same are administered to a subject for reducing, stopping progression of, or slowing progression of steatosis, fibrosis, and/or cirrhosis.

In some embodiments, the RNAi (e.g., IRS1 RNAi) or compositions containing the same are administered to a subject for inhibiting expression of IRS1. In some embodiments, inhibiting expression of IRS1 comprises reducing the expression of IRS1 compared to the expression of IRS1 prior to the administration of the RNAi. In some embodiments, inhibiting expression of IRS1 comprises eliminating the expression of IRS1.

In some embodiments, provided herein is a method of controlling or reducing liver fat accumulation in a subject, comprising administering to the subject an effective amount of a liver-targeted RNAi agent that inhibits expression of IRS1. In some embodiments, inhibiting expression of IRS1 comprises reducing the expression of IRS1 compared to the expression of IRS1 prior to the administration of the RNAi.

In some embodiments, inhibiting expression of IRS1 comprises eliminating the expression of IRS1 As used herein "reducing" liver fat accumulation refers to a decrease in liver fat compared to the amount of liver fat present prior to administration of the liver-targeting RNAi agent. In some embodiments, the liver fat accumulation is reduced any of about 1%, 5%, 10%, 15%, 20%, 25%, 30%, 35%, 40%, 45%, 50%, 55%, 60%, 65%, 70%, 75%, 80%, 85%, 90%, 95%, or more, compared to the amount of liver fat present prior to administration of the liver-targeting RNAi agent.

In some embodiments, the subject is an adult subject. In some embodiments, the subject is ≥18 years of age. In some embodiments, the subject to be treated is human. In some embodiments, the subject, to whom the RNAi agent or compositions are administered, is a primate, such as a human. In some embodiments, the subject, to whom the RNAi agent or compositions are administered, is a non-human primate. In some embodiments, the non-human primate is a monkey (e.g., cynomolgus monkey) or an ape. The subject can be male or female and can be any suitable age, including infant, juvenile, adolescent, adult, and geriatric subjects. In some embodiments, the subject is a non-primate mammal, such as a rodent (e.g., mouse, rat, etc.). In some examples, the patient or subject is a validated animal model for nonalcoholic fatty liver disease and/or for assessing toxic outcomes.

The RNAi agent can be administered by any suitable means, for example, by injection, e.g., intravenous or subcutaneous injections, intraocular injection, periocular injection, subretinal injection, intravitreal injection, trans-septal injection, subscleral injection, intrachoroidal injection, intracameral injection, subconjunctival injection, subconjunctival injection, sub-Tenon's injection, retrobulbar injection, peribulbar injection, or posterior juxtascleral delivery. In some embodiments, they are administered by parenteral, intrapulmonary, and intranasal, and, if desired for local treatment, intralesional administration. Parenteral infusions include intramuscular, intravenous, intraarterial, intraperitoneal, intracranial, intrathoracic, or subcutaneous administration. Dosing and administration may depend in part on whether the administration is brief or chronic. Various dosing schedules include but are not limited to single or multiple administrations over various time-points, bolus administration, and pulse infusion.

For the prevention or treatment of disease, the appropriate dosage of the RNAi agent may depend on the type of disease to be treated, the severity and course of the disease, whether the RNAi agent is administered for preventive or therapeutic purposes, the patient's clinical history and response to the RNAi agent, and the discretion of the attending physician. In some embodiments, the RNAi agent and/or composition are suitably administered to the patient at one time or over a series of treatments.

In some embodiments, the dose and/or frequency of administration is/are determined based on efficacy and/or response. In some embodiments, efficacy is determined by evaluating disease status. Exemplary methods for assessing disease status include: decrease of IRS1 gene expression, decrease of IRS1 protein, decrease of liver enzymes aspartate aminotransferase (AST) and/or alanine aminotransferase (ALT), decrease of liver nodules, or decrease of inflammation in the liver.

In some embodiments, toxicity and/or side-effects of treatment can be monitored and used to adjust dose and/or frequency of administration of the RNAi agent and/or compositions. For example, adverse events and laboratory abnormalities can be monitored and used to adjust dose and/or frequency of administration. Any of such events may establish dose-limiting toxicities and warrant decrease in dose and/or a termination of treatment.

In some embodiments, the RNAi agent provided herein (e.g. IRS1 RNAi) is used to treat or manage a clinical presentation wherein a subject has or is suspected of having nonalcoholic fatty liver disease. The subject is administered a therapeutically or effective amount of one or more of the RNAi agents (e.g. IRS1 RNAi) or RNAi agent-containing compositions described herein. In some embodiments, the method comprises administering a composition comprising an IRS1 RNAi agent described herein to a subject to be treated.

In some embodiments, the gene expression level and/or mRNA level of IRS1 gene in a subject to whom a described IRS1 RNAi agent is administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the IRS1 RNAi agent or to a subject not receiving the IRS1 RNAi agent. The gene expression level and/or mRNA level in the subject may be reduced in a cell, group of cells, and/or tissue of the subject. In some embodiments, the expressed protein level of IRS1 gene in a subject to whom a described IRS1 RNAi agent has been administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the IRS1 RNAi agent or to a subject not receiving the IRS1 RNAi agent. The protein level in the subject may be reduced in a cell, group of cells, tissue, blood, and/or other fluid of the subject.

In some embodiments, the amount or level of alanine aminotransferase (ALT) in the blood of a subject to whom the described IRS1 RNAi agent has been administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the IRS1 RNAi agent or to a subject not receiving the IRS1 RNAi agent. In some embodiments, the amount or level of aspartate aminotransferase (AST) in the blood of a subject to whom the described IRS1 RNAi agent has been administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the IRS1 RNAi agent or to a subject not receiving the IRS1 RNAi agent.

A reduction in the presence of ALT, AST, IRS1 gene expression, IRS1 mRNA, or IRS1 protein amounts or levels may be assessed by methods known in the art. Reduction or decrease in IRS1 mRNA amount or level, expressed protein amount or level, and/or liver enzymes ALT or AST amount or level, are collectively referred to herein as treating or ameliorating nonalcoholic fatty liver disease.

In some embodiments, the amount or size of liver nodules of the liver of the subject to whom the described IRS1 RNAi agent has been administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the IRS1 RNAi agent or to a subject not receiving the IRS1 RNAi agent. In some embodiments, imaging tests may be used to diagnose NAFLD and/or NASH. These imaging tests may include, but are not limited to, ultrasound, computed tomography (CT) scan, magnetic resonance imaging (MRI), and elastography.

In some embodiments, the amount or level inflammation in the liver of a subject to whom the described IRS1 RNAi agent has been administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the IRS1 RNAi agent or to a subject not receiving the IRS1 RNAi agent. In some embodiments, the amount of fibrotic damage in the liver of a subject to whom the described IRS1 RNAi agent has been administered is reduced by at least about 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the IRS1 RNAi agent or to a subject not receiving the IRS1 RNAi agent. In some embodiments, reduction in liver inflammation or fibrotic damage may be determined by any method known in the art. In some embodiments, the subject may undergo a liver biopsy in order to diagnosis fibrosis.

In some embodiments, the RNAi agent or compositions containing the same are co-administered with one or more additional therapeutic agents or in connection with another therapeutic intervention, either simultaneously or sequentially in any order. In some contexts, the RNAi agent or compositions are co-administered with another therapy sufficiently close in time such that the RNAi agent enhances the effect of one or more additional therapeutic agents, or vice versa. In some embodiments, the RNAi agent or compositions are administered prior to the one or more additional therapeutic agents. In some embodiments, the RNAi agent or compositions are administered after to the one or more additional therapeutic agents.

V. ARTICLES OF MANUFACTURE AND KITS

Also provided are articles of manufacture containing the RNAi agent and/or compositions thereof. The articles of manufacture may include a container and a label or package insert on or associated with the container. Suitable containers include, for example, bottles, vials, syringes, IV solution bags, etc. The containers may be formed from a variety of materials such as glass or plastic. The container in some embodiments holds a composition which is by itself or combined with another composition effective for treating, preventing and/or diagnosing the condition. In some embodiments, the container has a sterile access port. Exemplary containers include an intravenous solution bags, vials, including those with stoppers pierceable by a needle for injection, or bottles or vials for orally administered agents. The label or package insert may indicate that the composition is used for treating a disease or condition.

The article of manufacture may further include a package insert indicating that the compositions can be used to treat a particular condition. Alternatively, or additionally, the article of manufacture may further include another or the same container comprising a pharmaceutically-acceptable buffer. It may further include other materials such as other buffers, diluents, filters, needles, and/or syringes.

VI. EXEMPLARY EMBODIMENTS

The following embodiments are exemplary and are not intended to limit the scope of the invention or inventions described herein. Among the provided embodiments are:

Embodiment 1. An RNAi agent that inhibits expression of insulin receptor substrate-1 (IRS1) comprising an antisense strand and a sense strand that at least partially complements the antisense strand, wherein:

(a) the antisense strand comprises at least 14 contiguous bases from any one of SEQ ID NOS: 1-96, 385-457, and 677-688; and/or (b) the sense strand comprises at least 14 contiguous bases from any one of SEQ ID NOS: 97-192, 458-530, and 689-700.

Embodiment 2. The RNAi agent of embodiment 1, wherein one or more bases of the antisense stand and/or the sense strand are modified.

Embodiment 3. The RNAi agent of embodiment 2, wherein the antisense strand has a modification pattern according to nsNfsnnnNfnnnnnnnNfnNfnnnnnsnsn.

Embodiment 4. The RNAi agent of embodiment 2 or 3, wherein the sense strand has a modification pattern according to nsnsnnnnNfnNfNfNfnnnnnnnnnsnsn.

Embodiment 5. The RNAi agent of embodiment 2 or 3, wherein the sense strand has a modification pattern according to nsnsnnnnNfnNfNfNfnnnnnnnnnnn.

Embodiment 6. The RNAi agent of any one of embodiments 1-5, wherein:

(a) the antisense strand comprises at least 14 contiguous bases from any one of SEQ ID NOS: 193-288, 531-603, and 701-712; and/or (b) the sense strand comprises at least 14 contiguous bases from any one of SEQ ID NOS: 289-384, 604-676, 713-724, and 726-731.

Embodiment 7. An RNAi agent that inhibits expression of insulin receptor substrate-1 (IRS1) comprising an antisense strand and a sense strand that at least partially complements the antisense strand, and a targeting ligand conjugated to the antisense strand or the sense strand, wherein the targeting ligand targets a hepatocyte.

Embodiment 8. The RNAi agent of any one of embodiments 1-7, wherein the antisense strand comprises at least 14 contiguous bases that complement a sequence in an mRNA molecule that encodes IRS1 (SEQ ID NO: 725).

Embodiment 9. The RNAi agent of any one of embodiments 1-8, wherein the antisense strand and the sense strand form a duplex of at least 14 bases in length.

Embodiment 10. The RNAi agent of any one of embodiments 1-9, wherein the antisense strand and the sense strand form a duplex of between 15 and 30 bases in length.

Embodiment 11. The RNAi agent of any one of embodiments 1-10, wherein the antisense strand or a subsequence thereof differs by 0, 1, 2, 3, or 4 nucleotides from an equal length portion of any one of SEQ ID NOS: 1-96, 385-457, 677-688, 193-288, 531-603, and 701-712, wherein the subsequence is at least 14, 15, 16, 17, 18, 19, 20, or 21 bases in length.

Embodiment 12. The RNAi agent of embodiment 11, wherein the antisense strand comprises, in order, nucleotides 2-23 of any one of SEQ ID NOS: 1-96, 385-457, 677-688, 193-288, 531-603, and 701-712.

Embodiment 13. The RNAi agent of any one of embodiments 7-12, wherein the antisense strand comprises at least 14 contiguous bases from any one of SEQ ID NOS: 1-96, 385-457, 677-688, 193-288, 531-603, and 701-712.

Embodiment 14. The RNAi agent of any one of embodiments 7-13, wherein the antisense strand comprises, in order, nucleobases 1-14 of any one of SEQ ID NOS: 1-96, 385-457, 677-688, 193-288, 531-603, and 701-712.

Embodiment 15. The RNAi agent of any one of embodiments 1-14, wherein the antisense strand comprises at least 14 contiguous bases from any one of SEQ ID NOS: 449, 450, 457, 595, 596, 603, 677, 679, 680, 701, 703, and 704.

Embodiment 16. The RNAi agent of any one of embodiments 1-15, wherein the sense strand or a subsequence thereof differs by 0, 1, 2, 3, or 4 nucleotides from an equal length portion of any one of SEQ ID NOS: 97-192, 458-530, 689-700, 289-384, 604-676, 713-724, and 726-731, wherein the subsequence is at least 14, 15, 16, 17, 18, 19, 20, or 21 bases in length.

Embodiment 17. The RNAi agent of embodiment 16, wherein the sense strand comprises, in order, nucleotides 1-22 of any one of SEQ ID NOS: 97-192, 458-530, 689-700, 289-384, 604-676, 713-724, and 726-731.

Embodiment 18. The RNAi agent of any one of embodiments 1-17, wherein the sense strand comprises at least 14 contiguous bases from any one of SEQ ID NOS: 97-192, 458-530, 689-700, 289-384, 604-676, 713-724, and 726-731.

Embodiment 19. The RNAi agent of any one of embodiments 1-18, wherein the sense strand comprises, in order, nucleobases 1-14 of any one of SEQ ID NOS: 97-192, 458-530, 689-700, 289-384, 604-676, 713-724, and 726-731.

Embodiment 20. The RNAi agent of any one of embodiments 19, wherein the sense strand comprises at least 14 contiguous bases from any one of SEQ ID NOS: 522, 523, 530, 689, 691, 692, 668, 669, 676, 713, 715, 716, and 726-731.

Embodiment 21. The RNAi agent of any one of embodiments 1-20, wherein the antisense strand comprises at least 16 contiguous bases that complement a sequence in an mRNA molecule that encodes IRS1 (SEQ ID NO: 725).

Embodiment 22. The RNAi agent of any one of embodiments 1-21, wherein the antisense strand and the sense strand form a duplex of at least 16 bases in length.

Embodiment 23. The RNAi agent of any one of embodiments 1-22, wherein the antisense strand comprises at least 16 contiguous bases from any one of SEQ ID NOS: 1-96, 385-457, 677-688, 193-288, 531-603, and 701-712.

Embodiment 24. The RNAi agent of embodiment 23, wherein the antisense strand comprises at least 16 contiguous bases from any one of SEQ ID NOS: 449, 450, 457, 595, 596, 603, 677, 679, 680, 701, 703, and 704.

Embodiment 25. The RNAi agent of any one of embodiments 1-24, wherein the antisense strand comprises, in order, nucleobases 1-16, 1-17, 1-18, 1-19, 1-20, 1-21, 1-22, 1-23, 2-17, 2-18, 2-19, 2-20, 2-21, 2-22, 2-23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 1-96, 385-457, 677-688, 193-288, 531-603, and 701-712.

Embodiment 26. The RNAi agent of any one of embodiments 1-25, wherein the antisense strand comprises a nucleotide sequence according to any one of SEQ ID NOS: 1-96, 385-457, and 677-688.

Embodiment 27. The RNAi agent of embodiment 26, wherein one or more nucleotides are modified.

Embodiment 28. The RNAi agent of embodiment 26, wherein the antisense strand comprises a nucleotide sequence according to any one of SEQ ID NOS: 449, 450, 457, 677, 679, and 680.

Embodiment 29. The RNAi agent of embodiment 28, wherein one or more nucleotides are modified.

Embodiment 30. The RNAi agent of embodiment 27 or 29, wherein the antisense strand has a modification pattern according to nsNfsnnnNfnnnnnnnNfnNfnnnnnsnsn.

Embodiment 31. The RNAi agent of any one of embodiments 26-30, wherein the antisense strand comprises a modified nucleotide sequence according to any one of SEQ ID NOS: 193-288, 531-603, and 701-712.

Embodiment 32. The RNAi agent of embodiment 31, wherein the antisense strand comprises a modified nucleotide sequence according to any one of SEQ ID NOS: 595, 596, 603, 701, 703, and 704.

Embodiment 33. The RNAi agent of any one of embodiments 1-32, wherein the sense strand comprises at least 16 contiguous bases from any one of SEQ ID NOS: 97-192, 458-530, 689-700, 289-384, 604-676, 713-724, and 726-731.

Embodiment 34. The RNAi agent of embodiment 33, wherein the sense strand comprises at least 16 contiguous bases from any one of SEQ ID NOS: 522, 523, 530, 689, 691, 692, and 726-731.

Embodiment 35. The RNAi agent of any one of embodiments 1-34, wherein the sense strand comprises, in order, nucleobases 1-16, 1-17, 1-18, 1-19, 1-20, 1-21, 1-22, 1-23, 2-17, 2-18, 2-19, 2-20, 2-21, 2-22, 2-23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 97-192, 458-530, 689-700, 289-384, 604-676, 713-724, and 726-731.

Embodiment 36. The RNAi agent of any one of embodiments 1-35, wherein the sense strand comprises a nucleobase sequence according to any one of SEQ ID NOS: 97-192, 458-530, and 689-700.

Embodiment 37. The RNAi agent of embodiment 36, wherein one or more nucleotides are modified.

Embodiment 38. The RNAi agent of embodiment 36, wherein the sense strand comprises a nucleobase sequence according to any one of SEQ ID NOS: 522, 523, 530, 689, 691, and 692.

Embodiment 39. The RNAi agent of embodiment 38, wherein one or more nucleotides are modified.

Embodiment 40. The RNAi agent of embodiment 37 or 39, wherein the sense strand has a modification pattern according to nsnsnnnnNfnNfNfNfnnnnnnnnsnsn.

Embodiment 41. The RNAi agent of embodiment 37 or 39, wherein the sense strand has a modification pattern according to nsnsnnnnNfnNfNfNfnnnnnnnnnn.

Embodiment 42. The RNAi agent of any one of embodiments 36-41, wherein the sense strand comprises a modified nucleotide sequence according to any one of SEQ ID NOS: 289-384, 604-676, 713-724, and 726-731.

Embodiment 43. The RNAi agent of embodiment 42, wherein the sense strand comprises a modified nucleotide sequence according to any one of SEQ ID NOS: 668, 669, 676, 713, 715, 716, and 726-731.

Embodiment 44. The RNAi agent of any one of embodiments 1-43, wherein:

(a) the sense strand comprises a nucleobase sequence according to SEQ ID NO: 97 and the antisense strand comprises a nucleobase sequence according to SEQ ID NO: 1;

(b) the sense strand comprises a nucleobase sequence according to SEQ ID NO: 98 and the antisense strand comprises a nucleobase sequence according to SEQ ID NO: 2;

(c) the sense strand comprises a nucleobase sequence according to SEQ ID NO: 99 and the antisense strand comprises a nucleobase sequence according to SEQ ID NO: 3;

(d) the sense strand comprises a nucleobase sequence according to SEQ ID NO: 100 and the antisense strand comprises a nucleobase sequence according to SEQ ID NO: 4;

(e) the sense strand comprises a nucleobase sequence according to SEQ ID NO: 101 and the antisense strand comprises a nucleobase sequence according to SEQ ID NO: 5;

(f) the sense strand comprises a nucleobase sequence according to SEQ ID NO: 102 and the antisense strand comprises a nucleobase sequence according to SEQ ID NO: 6;

(g) the sense strand comprises a nucleobase sequence according to SEQ ID NO: 103 and the antisense strand comprises a nucleobase sequence according to SEQ ID NO: 7;

(h) the sense strand comprises a nucleobase sequence according to SEQ ID NO: 104 and the antisense strand comprises a nucleobase sequence according to SEQ ID NO: 8;

(i) the sense strand comprises a nucleobase sequence according to SEQ ID NO: 105 and the antisense strand comprises a nucleobase sequence according to SEQ ID NO: 9;

(j) the sense strand comprises a nucleobase sequence according to SEQ ID NO: 106 and the antisense strand comprises a nucleobase sequence according to SEQ ID NO: 10;

(k) the sense strand comprises a nucleobase sequence according to SEQ ID NO: 107 and the antisense strand comprises a nucleobase sequence according to SEQ ID NO: 11;

(l) the sense strand comprises a nucleobase sequence according to SEQ ID NO: 108 and the antisense strand comprises a nucleobase sequence according to SEQ ID NO: 12;

(m) the sense strand comprises a nucleobase sequence according to SEQ ID NO: 109 and the antisense strand comprises a nucleobase sequence according to SEQ ID NO: 13;

(n) the sense strand comprises a nucleobase sequence according to SEQ ID NO: 110 and the antisense strand comprises a nucleobase sequence according to SEQ ID NO: 14;

(o) the sense strand comprises a nucleobase sequence according to SEQ ID NO: 111 and the antisense strand comprises a nucleobase sequence according to SEQ ID NO: 15;

(p) the sense strand comprises a nucleobase sequence according to SEQ ID NO: 112 and the antisense strand comprises a nucleobase sequence according to SEQ ID NO: 16;

(q) the sense strand comprises a nucleobase sequence according to SEQ ID NO: 113 and the antisense strand comprises a nucleobase sequence according to SEQ ID NO: 17;

(r) the sense strand comprises a nucleobase sequence according to SEQ ID NO: 114 and the antisense strand comprises a nucleobase sequence according to SEQ ID NO: 18;

(s) the sense strand comprises a nucleobase sequence according to SEQ ID NO: 115 and the antisense strand comprises a nucleobase sequence according to SEQ ID NO: 19;

(t) the sense strand comprises a nucleobase sequence according to SEQ ID NO: 116 and the antisense strand comprises a nucleobase sequence according to SEQ ID NO: 20;

(u) the sense strand comprises a nucleobase sequence according to SEQ ID NO: 117 and the antisense strand comprises a nucleobase sequence according to SEQ ID NO: 21;

(v) the sense strand comprises a nucleobase sequence according to SEQ ID NO: 118 and the antisense strand comprises a nucleobase sequence according to SEQ ID NO: 22;

(w) the sense strand comprises a nucleobase sequence according to SEQ ID NO: 119 and the antisense strand comprises a nucleobase sequence according to SEQ ID NO: 23;

(x) the sense strand comprises a nucleobase sequence according to SEQ ID NO: 120 and the antisense strand comprises a nucleobase sequence according to SEQ ID NO: 24;

(y) the sense strand comprises a nucleobase sequence according to SEQ ID NO: 121 and the antisense strand comprises a nucleobase sequence according to SEQ ID NO: 25;

(z) the sense strand comprises a nucleobase sequence according to SEQ ID NO: 122 and the antisense strand comprises a nucleobase sequence according to SEQ ID NO: 26;

(aa) the sense strand comprises a nucleobase sequence according to SEQ ID NO: 123 and the antisense strand comprises a nucleobase sequence according to SEQ ID NO: 27;

(bb) the sense strand comprises a nucleobase sequence according to SEQ ID NO: 124 and the antisense strand comprises a nucleobase sequence according to SEQ ID NO: 28;

(cc) the sense strand comprises a nucleobase sequence according to SEQ ID NO: 125 and the antisense strand comprises a nucleobase sequence according to SEQ ID NO: 29;

(dd) the sense strand comprises a nucleobase sequence according to SEQ ID NO: 126 and the antisense strand comprises a nucleobase sequence according to SEQ ID NO: 30;

(ee) the sense strand comprises a nucleobase sequence according to SEQ ID NO: 127 and the antisense strand comprises a nucleobase sequence according to SEQ ID NO: 31;

(ff) the sense strand comprises a nucleobase sequence according to SEQ ID NO: 128 and the antisense strand comprises a nucleobase sequence according to SEQ ID NO: 32;

(gg) the sense strand comprises a nucleobase sequence according to SEQ ID NO: 129 and the antisense strand comprises a nucleobase sequence according to SEQ ID NO: 33;

(hh) the sense strand comprises a nucleobase sequence according to SEQ ID NO: 130 and the antisense strand comprises a nucleobase sequence according to SEQ ID NO: 34;

(ii) the sense strand comprises a nucleobase sequence according to SEQ ID NO: 131 and the antisense strand comprises a nucleobase sequence according to SEQ ID NO: 35;

(jj) the sense strand comprises a nucleobase sequence according to SEQ ID NO: 132 and the antisense strand comprises a nucleobase sequence according to SEQ ID NO: 36;

(kk) the sense strand comprises a nucleobase sequence according to SEQ ID NO: 133 and the antisense strand comprises a nucleobase sequence according to SEQ ID NO: 37;

(ll) the sense strand comprises a nucleobase sequence according to SEQ ID NO: 134 and the antisense strand comprises a nucleobase sequence according to SEQ ID NO: 38;

(mm) the sense strand comprises a nucleobase sequence according to SEQ ID NO: 135 and the antisense strand comprises a nucleobase sequence according to SEQ ID NO: 39;

(nn) the sense strand comprises a nucleobase sequence according to SEQ ID NO: 136 and the antisense strand comprises a nucleobase sequence according to SEQ ID NO: 40;

(oo) the sense strand comprises a nucleobase sequence according to SEQ ID NO: 137 and the antisense strand comprises a nucleobase sequence according to SEQ ID NO: 41;

(pp) the sense strand comprises a nucleobase sequence according to SEQ ID NO: 138 and the antisense strand comprises a nucleobase sequence according to SEQ ID NO: 42;

(qq) the sense strand comprises a nucleobase sequence according to SEQ ID NO: 139 and the antisense strand comprises a nucleobase sequence according to SEQ ID NO: 43;

(rr) the sense strand comprises a nucleobase sequence according to SEQ ID NO: 140 and the antisense strand comprises a nucleobase sequence according to SEQ ID NO: 44;

(ss) the sense strand comprises a nucleobase sequence according to SEQ ID NO: 141 and the antisense strand comprises a nucleobase sequence according to SEQ ID NO: 45;

(tt) the sense strand comprises a nucleobase sequence according to SEQ ID NO: 142 and the antisense strand comprises a nucleobase sequence according to SEQ ID NO: 46;

(uu) the sense strand comprises a nucleobase sequence according to SEQ ID NO: 143 and the antisense strand comprises a nucleobase sequence according to SEQ ID NO: 47;

(vv) the sense strand comprises a nucleobase sequence according to SEQ ID NO: 144 and the antisense strand comprises a nucleobase sequence according to SEQ ID NO: 48;

(ww) the sense strand comprises a nucleobase sequence according to SEQ ID NO: 145 and the antisense strand comprises a nucleobase sequence according to SEQ ID NO: 49;

(xx) the sense strand comprises a nucleobase sequence according to SEQ ID NO: 146 and the antisense strand comprises a nucleobase sequence according to SEQ ID NO: 50;

(yy) the sense strand comprises a nucleobase sequence according to SEQ ID NO: 147 and the antisense strand comprises a nucleobase sequence according to SEQ ID NO: 51;

(zz) the sense strand comprises a nucleobase sequence according to SEQ ID NO: 148 and the antisense strand comprises a nucleobase sequence according to SEQ ID NO: 52;

(aaa) the sense strand comprises a nucleobase sequence according to SEQ ID NO: 149 and the antisense strand comprises a nucleobase sequence according to SEQ ID NO: 53;

(bbb) the sense strand comprises a nucleobase sequence according to SEQ ID NO: 150 and the antisense strand comprises a nucleobase sequence according to SEQ ID NO: 54;

(ccc) the sense strand comprises a nucleobase sequence according to SEQ ID NO: 151 and the antisense strand comprises a nucleobase sequence according to SEQ ID NO: 55;

(ddd) the sense strand comprises a nucleobase sequence according to SEQ ID NO: 152 and the antisense strand comprises a nucleobase sequence according to SEQ ID NO: 56;

(eee) the sense strand comprises a nucleobase sequence according to SEQ ID NO: 153 and the antisense strand comprises a nucleobase sequence according to SEQ ID NO: 57;

(fff) the sense strand comprises a nucleobase sequence according to SEQ ID NO: 154 and the antisense strand comprises a nucleobase sequence according to SEQ ID NO: 58;

(ggg) the sense strand comprises a nucleobase sequence according to SEQ ID NO: 155 and the antisense strand comprises a nucleobase sequence according to SEQ ID NO: 59;

(hhh) the sense strand comprises a nucleobase sequence according to SEQ ID NO: 156 and the antisense strand comprises a nucleobase sequence according to SEQ ID NO: 60;

(iii) the sense strand comprises a nucleobase sequence according to SEQ ID NO: 157 and the antisense strand comprises a nucleobase sequence according to SEQ ID NO: 61;

(jjj) the sense strand comprises a nucleobase sequence according to SEQ ID NO: 158 and the antisense strand comprises a nucleobase sequence according to SEQ ID NO: 62;

(kkk) the sense strand comprises a nucleobase sequence according to SEQ ID NO: 159 and the antisense strand comprises a nucleobase sequence according to SEQ ID NO: 63;

(lll) the sense strand comprises a nucleobase sequence according to SEQ ID NO: 160 and the antisense strand comprises a nucleobase sequence according to SEQ ID NO: 64;

(mmm) the sense strand comprises a nucleobase sequence according to SEQ ID NO: 161 and the antisense strand comprises a nucleobase sequence according to SEQ ID NO: 65;

(nnn) the sense strand comprises a nucleobase sequence according to SEQ ID NO: 162 and the antisense strand comprises a nucleobase sequence according to SEQ ID NO: 66;

(ooo) the sense strand comprises a nucleobase sequence according to SEQ ID NO: 163 and the antisense strand comprises a nucleobase sequence according to SEQ ID NO: 67;

(ppp) the sense strand comprises a nucleobase sequence according to SEQ ID NO: 164 and the antisense strand comprises a nucleobase sequence according to SEQ ID NO: 68;

(qqq) the sense strand comprises a nucleobase sequence according to SEQ ID NO: 165 and the antisense strand comprises a nucleobase sequence according to SEQ ID NO: 69;
(rrr) the sense strand comprises a nucleobase sequence according to SEQ ID NO: 166 and the antisense strand comprises a nucleobase sequence according to SEQ ID NO: 70;
(sss) the sense strand comprises a nucleobase sequence according to SEQ ID NO: 167 and the antisense strand comprises a nucleobase sequence according to SEQ ID NO: 71;
(ttt) the sense strand comprises a nucleobase sequence according to SEQ ID NO: 168 and the antisense strand comprises a nucleobase sequence according to SEQ ID NO: 72;
(uuu) the sense strand comprises a nucleobase sequence according to SEQ ID NO: 169 and the antisense strand comprises a nucleobase sequence according to SEQ ID NO: 73;
(vvv) the sense strand comprises a nucleobase sequence according to SEQ ID NO: 170 and the antisense strand comprises a nucleobase sequence according to SEQ ID NO: 74;
(www) the sense strand comprises a nucleobase sequence according to SEQ ID NO: 171 and the antisense strand comprises a nucleobase sequence according to SEQ ID NO: 75;
(xxx) the sense strand comprises a nucleobase sequence according to SEQ ID NO: 172 and the antisense strand comprises a nucleobase sequence according to SEQ ID NO: 76;
(yyy) the sense strand comprises a nucleobase sequence according to SEQ ID NO: 173 and the antisense strand comprises a nucleobase sequence according to SEQ ID NO: 77;
(zzz) the sense strand comprises a nucleobase sequence according to SEQ ID NO: 174 and the antisense strand comprises a nucleobase sequence according to SEQ ID NO: 78;
(aaaa) the sense strand comprises a nucleobase sequence according to SEQ ID NO: 175 and the antisense strand comprises a nucleobase sequence according to SEQ ID NO: 79;
(bbbb) the sense strand comprises a nucleobase sequence according to SEQ ID NO: 176 and the antisense strand comprises a nucleobase sequence according to SEQ ID NO: 80;
(cccc) the sense strand comprises a nucleobase sequence according to SEQ ID NO: 177 and the antisense strand comprises a nucleobase sequence according to SEQ ID NO: 81;
(dddd) the sense strand comprises a nucleobase sequence according to SEQ ID NO: 178 and the antisense strand comprises a nucleobase sequence according to SEQ ID NO: 82;
(eeee) the sense strand comprises a nucleobase sequence according to SEQ ID NO: 179 and the antisense strand comprises a nucleobase sequence according to SEQ ID NO: 83;
(ffff) the sense strand comprises a nucleobase sequence according to SEQ ID NO: 180 and the antisense strand comprises a nucleobase sequence according to SEQ ID NO: 84;
(gggg) the sense strand comprises a nucleobase sequence according to SEQ ID NO: 181 and the antisense strand comprises a nucleobase sequence according to SEQ ID NO: 85;
(hhhh) the sense strand comprises a nucleobase sequence according to SEQ ID NO: 182 and the antisense strand comprises a nucleobase sequence according to SEQ ID NO: 86;
(iiii) the sense strand comprises a nucleobase sequence according to SEQ ID NO: 183 and the antisense strand comprises a nucleobase sequence according to SEQ ID NO: 87;
(jjjj) the sense strand comprises a nucleobase sequence according to SEQ ID NO: 184 and the antisense strand comprises a nucleobase sequence according to SEQ ID NO: 88;
(kkkk) the sense strand comprises a nucleobase sequence according to SEQ ID NO: 185 and the antisense strand comprises a nucleobase sequence according to SEQ ID NO: 89;
(llll) the sense strand comprises a nucleobase sequence according to SEQ ID NO: 186 and the antisense strand comprises a nucleobase sequence according to SEQ ID NO: 90;
(mmmm) the sense strand comprises a nucleobase sequence according to SEQ ID NO: 187 and the antisense strand comprises a nucleobase sequence according to SEQ ID NO: 91;
(nnnn) the sense strand comprises a nucleobase sequence according to SEQ ID NO: 188 and the antisense strand comprises a nucleobase sequence according to SEQ ID NO: 92;
(oooo) the sense strand comprises a nucleobase sequence according to SEQ ID NO: 189 and the antisense strand comprises a nucleobase sequence according to SEQ ID NO: 93;
(pppp) the sense strand comprises a nucleobase sequence according to SEQ ID NO: 190 and the antisense strand comprises a nucleobase sequence according to SEQ ID NO: 94;
(qqqq) the sense strand comprises a nucleobase sequence according to SEQ ID NO: 191 and the antisense strand comprises a nucleobase sequence according to SEQ ID NO: 95;
(rrrr) the sense strand comprises a nucleobase sequence according to SEQ ID NO: 192 and the antisense strand comprises a nucleobase sequence according to SEQ ID NO: 96;
(ssss) the sense strand comprises a nucleobase sequence according to SEQ ID NO: 458 and the antisense strand comprises a nucleobase sequence according to SEQ ID NO: 385;
(tttt) the sense strand comprises a nucleobase sequence according to SEQ ID NO: 459 and the antisense strand comprises a nucleobase sequence according to SEQ ID NO: 386;
(uuuu) the sense strand comprises a nucleobase sequence according to SEQ ID NO: 460 and the antisense strand comprises a nucleobase sequence according to SEQ ID NO: 387;
(vvvv) the sense strand comprises a nucleobase sequence according to SEQ ID NO: 461 and the antisense strand comprises a nucleobase sequence according to SEQ ID NO: 388;
(wwww) the sense strand comprises a nucleobase sequence according to SEQ ID NO: 462 and the antisense strand comprises a nucleobase sequence according to SEQ ID NO: 389;

(xxxx) the sense strand comprises a nucleobase sequence according to SEQ ID NO: 463 and the antisense strand comprises a nucleobase sequence according to SEQ ID NO: 390;

(yyyy) the sense strand comprises a nucleobase sequence according to SEQ ID NO: 464 and the antisense strand comprises a nucleobase sequence according to SEQ ID NO: 391;

(zzzz) the sense strand comprises a nucleobase sequence according to SEQ ID NO: 465 and the antisense strand comprises a nucleobase sequence according to SEQ ID NO: 392;

(aaaaa) the sense strand comprises a nucleobase sequence according to SEQ ID NO: 466 and the antisense strand comprises a nucleobase sequence according to SEQ ID NO: 393;

(bbbbb) the sense strand comprises a nucleobase sequence according to SEQ ID NO: 467 and the antisense strand comprises a nucleobase sequence according to SEQ ID NO: 394;

(ccccc) the sense strand comprises a nucleobase sequence according to SEQ ID NO: 468 and the antisense strand comprises a nucleobase sequence according to SEQ ID NO: 395;

(ddddd) the sense strand comprises a nucleobase sequence according to SEQ ID NO: 469 and the antisense strand comprises a nucleobase sequence according to SEQ ID NO: 396;

(eeeee) the sense strand comprises a nucleobase sequence according to SEQ ID NO: 470 and the antisense strand comprises a nucleobase sequence according to SEQ ID NO: 397;

(fffff) the sense strand comprises a nucleobase sequence according to SEQ ID NO: 471 and the antisense strand comprises a nucleobase sequence according to SEQ ID NO: 398;

(ggggg) the sense strand comprises a nucleobase sequence according to SEQ ID NO: 472 and the antisense strand comprises a nucleobase sequence according to SEQ ID NO: 399;

(hhhhh) the sense strand comprises a nucleobase sequence according to SEQ ID NO: 473 and the antisense strand comprises a nucleobase sequence according to SEQ ID NO: 400;

(iiiii) the sense strand comprises a nucleobase sequence according to SEQ ID NO: 474 and the antisense strand comprises a nucleobase sequence according to SEQ ID NO: 401;

(jjjjj) the sense strand comprises a nucleobase sequence according to SEQ ID NO: 475 and the antisense strand comprises a nucleobase sequence according to SEQ ID NO: 402;

(kkkkk) the sense strand comprises a nucleobase sequence according to SEQ ID NO: 476 and the antisense strand comprises a nucleobase sequence according to SEQ ID NO: 403;

(lllll) the sense strand comprises a nucleobase sequence according to SEQ ID NO: 477 and the antisense strand comprises a nucleobase sequence according to SEQ ID NO: 404;

(mmmmm) the sense strand comprises a nucleobase sequence according to SEQ ID NO: 478 and the antisense strand comprises a nucleobase sequence according to SEQ ID NO: 405;

(nnnnn) the sense strand comprises a nucleobase sequence according to SEQ ID NO: 479 and the antisense strand comprises a nucleobase sequence according to SEQ ID NO: 406;

(ooooo) the sense strand comprises a nucleobase sequence according to SEQ ID NO: 480 and the antisense strand comprises a nucleobase sequence according to SEQ ID NO: 407;

(ppppp) the sense strand comprises a nucleobase sequence according to SEQ ID NO: 481 and the antisense strand comprises a nucleobase sequence according to SEQ ID NO: 408;

(qqqqq) the sense strand comprises a nucleobase sequence according to SEQ ID NO: 482 and the antisense strand comprises a nucleobase sequence according to SEQ ID NO: 409;

(rrrrr) the sense strand comprises a nucleobase sequence according to SEQ ID NO: 483 and the antisense strand comprises a nucleobase sequence according to SEQ ID NO: 410;

(sssss) the sense strand comprises a nucleobase sequence according to SEQ ID NO: 484 and the antisense strand comprises a nucleobase sequence according to SEQ ID NO: 411;

(ttttt) the sense strand comprises a nucleobase sequence according to SEQ ID NO: 485 and the antisense strand comprises a nucleobase sequence according to SEQ ID NO: 412;

(uuuuu) the sense strand comprises a nucleobase sequence according to SEQ ID NO: 486 and the antisense strand comprises a nucleobase sequence according to SEQ ID NO: 413;

(vvvvv) the sense strand comprises a nucleobase sequence according to SEQ ID NO: 487 and the antisense strand comprises a nucleobase sequence according to SEQ ID NO: 414;

(wwwww) the sense strand comprises a nucleobase sequence according to SEQ ID NO: 488 and the antisense strand comprises a nucleobase sequence according to SEQ ID NO: 415;

(xxxxx) the sense strand comprises a nucleobase sequence according to SEQ ID NO: 489 and the antisense strand comprises a nucleobase sequence according to SEQ ID NO: 416;

(yyyyy) the sense strand comprises a nucleobase sequence according to SEQ ID NO: 490 and the antisense strand comprises a nucleobase sequence according to SEQ ID NO: 417;

(zzzzz) the sense strand comprises a nucleobase sequence according to SEQ ID NO: 491 and the antisense strand comprises a nucleobase sequence according to SEQ ID NO: 418;

(aaaaaa) the sense strand comprises a nucleobase sequence according to SEQ ID NO: 492 and the antisense strand comprises a nucleobase sequence according to SEQ ID NO: 419;

(bbbbbb) the sense strand comprises a nucleobase sequence according to SEQ ID NO: 493 and the antisense strand comprises a nucleobase sequence according to SEQ ID NO: 420;

(cccccc) the sense strand comprises a nucleobase sequence according to SEQ ID NO: 494 and the antisense strand comprises a nucleobase sequence according to SEQ ID NO: 421;

(dddddd) the sense strand comprises a nucleobase sequence according to SEQ ID NO: 495 and the antisense strand comprises a nucleobase sequence according to SEQ ID NO: 422;

(eeeeee) the sense strand comprises a nucleobase sequence according to SEQ ID NO: 496 and the antisense strand comprises a nucleobase sequence according to SEQ ID NO: 423;

(ffffff) the sense strand comprises a nucleobase sequence according to SEQ ID NO: 497 and the antisense strand comprises a nucleobase sequence according to SEQ ID NO: 424;

(gggggg) the sense strand comprises a nucleobase sequence according to SEQ ID NO: 498 and the antisense strand comprises a nucleobase sequence according to SEQ ID NO: 425;

(hhhhhh) the sense strand comprises a nucleobase sequence according to SEQ ID NO: 499 and the antisense strand comprises a nucleobase sequence according to SEQ ID NO: 426;

(iiiiii) the sense strand comprises a nucleobase sequence according to SEQ ID NO: 500 and the antisense strand comprises a nucleobase sequence according to SEQ ID NO: 427;

(jjjjjj) the sense strand comprises a nucleobase sequence according to SEQ ID NO: 501 and the antisense strand comprises a nucleobase sequence according to SEQ ID NO: 428;

(kkkkkk) the sense strand comprises a nucleobase sequence according to SEQ ID NO: 502 and the antisense strand comprises a nucleobase sequence according to SEQ ID NO: 429;

(llllll) the sense strand comprises a nucleobase sequence according to SEQ ID NO: 503 and the antisense strand comprises a nucleobase sequence according to SEQ ID NO: 430;

(mmmmmm) the sense strand comprises a nucleobase sequence according to SEQ ID NO: 504 and the antisense strand comprises a nucleobase sequence according to SEQ ID NO: 431;

(nnnnnn) the sense strand comprises a nucleobase sequence according to SEQ ID NO: 505 and the antisense strand comprises a nucleobase sequence according to SEQ ID NO: 432;

(oooooo) the sense strand comprises a nucleobase sequence according to SEQ ID NO: 506 and the antisense strand comprises a nucleobase sequence according to SEQ ID NO: 433;

(pppppp) the sense strand comprises a nucleobase sequence according to SEQ ID NO: 507 and the antisense strand comprises a nucleobase sequence according to SEQ ID NO: 434;

(qqqqqq) the sense strand comprises a nucleobase sequence according to SEQ ID NO: 508 and the antisense strand comprises a nucleobase sequence according to SEQ ID NO: 435;

(rrrrrr) the sense strand comprises a nucleobase sequence according to SEQ ID NO: 509 and the antisense strand comprises a nucleobase sequence according to SEQ ID NO: 436;

(ssssss) the sense strand comprises a nucleobase sequence according to SEQ ID NO: 510 and the antisense strand comprises a nucleobase sequence according to SEQ ID NO: 437;

(tttttt) the sense strand comprises a nucleobase sequence according to SEQ ID NO: 511 and the antisense strand comprises a nucleobase sequence according to SEQ ID NO: 438;

(uuuuuu) the sense strand comprises a nucleobase sequence according to SEQ ID NO: 512 and the antisense strand comprises a nucleobase sequence according to SEQ ID NO: 439;

(vvvvvv) the sense strand comprises a nucleobase sequence according to SEQ ID NO: 513 and the antisense strand comprises a nucleobase sequence according to SEQ ID NO: 440;

(wwwwww) the sense strand comprises a nucleobase sequence according to SEQ ID NO: 514 and the antisense strand comprises a nucleobase sequence according to SEQ ID NO: 441;

(xxxxxx) the sense strand comprises a nucleobase sequence according to SEQ ID NO: 515 and the antisense strand comprises a nucleobase sequence according to SEQ ID NO: 442;

(yyyyyy) the sense strand comprises a nucleobase sequence according to SEQ ID NO: 516 and the antisense strand comprises a nucleobase sequence according to SEQ ID NO: 443;

(zzzzzz) the sense strand comprises a nucleobase sequence according to SEQ ID NO: 517 and the antisense strand comprises a nucleobase sequence according to SEQ ID NO: 444;

(aaaaaaa) the sense strand comprises a nucleobase sequence according to SEQ ID NO: 518 and the antisense strand comprises a nucleobase sequence according to SEQ ID NO: 445;

(bbbbbbb) the sense strand comprises a nucleobase sequence according to SEQ ID NO: 519 and the antisense strand comprises a nucleobase sequence according to SEQ ID NO: 446;

(ccccccc) the sense strand comprises a nucleobase sequence according to SEQ ID NO: 520 and the antisense strand comprises a nucleobase sequence according to SEQ ID NO: 447;

(ddddddd) the sense strand comprises a nucleobase sequence according to SEQ ID NO: 521 and the antisense strand comprises a nucleobase sequence according to SEQ ID NO: 448;

(eeeeeee) the sense strand comprises a nucleobase sequence according to SEQ ID NO: 522 and the antisense strand comprises a nucleobase sequence according to SEQ ID NO: 449;

(fffffff) the sense strand comprises a nucleobase sequence according to SEQ ID NO: 523 and the antisense strand comprises a nucleobase sequence according to SEQ ID NO: 450;

(ggggggg) the sense strand comprises a nucleobase sequence according to SEQ ID NO: 524 and the antisense strand comprises a nucleobase sequence according to SEQ ID NO: 451;

(hhhhhhh) the sense strand comprises a nucleobase sequence according to SEQ ID NO: 525 and the antisense strand comprises a nucleobase sequence according to SEQ ID NO: 452;

(iiiiiii) the sense strand comprises a nucleobase sequence according to SEQ ID NO: 526 and the antisense strand comprises a nucleobase sequence according to SEQ ID NO: 453;

(jjjjjjj) the sense strand comprises a nucleobase sequence according to SEQ ID NO: 527 and the antisense strand comprises a nucleobase sequence according to SEQ ID NO: 454;

(kkkkkkk) the sense strand comprises a nucleobase sequence according to SEQ ID NO: 528 and the antisense strand comprises a nucleobase sequence according to SEQ ID NO: 455;

(lllllll) the sense strand comprises a nucleobase sequence according to SEQ ID NO: 529 and the antisense strand comprises a nucleobase sequence according to SEQ ID NO: 456;

(mmmmmmm) the sense strand comprises a nucleobase sequence according to SEQ ID NO: 530 and the antisense strand comprises a nucleobase sequence according to SEQ ID NO: 457;

(nnnnnnn) the sense strand comprises a nucleobase sequence according to SEQ ID NO: 689 and the antisense strand comprises a nucleobase sequence according to SEQ ID NO: 677;

(ooooooo) the sense strand comprises a nucleobase sequence according to SEQ ID NO: 690 and the antisense strand comprises a nucleobase sequence according to SEQ ID NO: 678;

(ppppppp) the sense strand comprises a nucleobase sequence according to SEQ ID NO: 691 and the antisense strand comprises a nucleobase sequence according to SEQ ID NO: 679;

(qqqqqqq) the sense strand comprises a nucleobase sequence according to SEQ ID NO: 692 and the antisense strand comprises a nucleobase sequence according to SEQ ID NO: 680;

(rrrrrrr) the sense strand comprises a nucleobase sequence according to SEQ ID NO: 693 and the antisense strand comprises a nucleobase sequence according to SEQ ID NO: 681;

(sssssss) the sense strand comprises a nucleobase sequence according to SEQ ID NO: 694 and the antisense strand comprises a nucleobase sequence according to SEQ ID NO: 682;

(ttttttt) the sense strand comprises a nucleobase sequence according to SEQ ID NO: 695 and the antisense strand comprises a nucleobase sequence according to SEQ ID NO: 683;

(uuuuuuu) the sense strand comprises a nucleobase sequence according to SEQ ID NO: 696 and the antisense strand comprises a nucleobase sequence according to SEQ ID NO: 684;

(vvvvvvv) the sense strand comprises a nucleobase sequence according to SEQ ID NO: 697 and the antisense strand comprises a nucleobase sequence according to SEQ ID NO: 685;

(wwwwwww) the sense strand comprises a nucleobase sequence according to SEQ ID NO: 698 and the antisense strand comprises a nucleobase sequence according to SEQ ID NO: 686;

(xxxxxxx) the sense strand comprises a nucleobase sequence according to SEQ ID NO: 699 and the antisense strand comprises a nucleobase sequence according to SEQ ID NO: 687; or (yyyyyyy) the sense strand comprises a nucleobase sequence according to SEQ ID NO: 700 and the antisense strand comprises a nucleobase sequence according to SEQ ID NO: 688.

Embodiment 45. The RNAi agent of embodiment 44, wherein:

(a) the sense strand comprises a nucleobase sequence according to SEQ ID NO: 530 and the antisense strand comprises a nucleobase sequence according to SEQ ID NO: 457;

(b) the sense strand comprises a nucleobase sequence according to SEQ ID NO: 523 and the antisense strand comprises a nucleobase sequence according to SEQ ID NO: 450;

(c) the sense strand comprises a nucleobase sequence according to SEQ ID NO: 691 and the antisense strand comprises a nucleobase sequence according to SEQ ID NO: 679;

(d) the sense strand comprises a nucleobase sequence according to SEQ ID NO: 689 and the antisense strand comprises a nucleobase sequence according to SEQ ID NO: 677;

(e) the sense strand comprises a nucleobase sequence according to SEQ ID NO: 522 and the antisense strand comprises a nucleobase sequence according to SEQ ID NO: 449; or (f) the sense strand comprises a nucleobase sequence according to SEQ ID NO: 692 and the antisense strand comprises a nucleobase sequence according to SEQ ID NO: 680.

Embodiment 46. The RNAi agent of embodiment 44 or 45, wherein:

(a) the sense strand comprises a modified nucleotide sequence according to SEQ ID NO: 289 and the antisense strand comprises a modified nucleotide sequence according to SEQ ID NO: 193;

(b) the sense strand comprises a modified nucleotide sequence according to SEQ ID NO: 290 and the antisense strand comprises a modified nucleotide sequence according to SEQ ID NO: 194;

(c) the sense strand comprises a modified nucleotide sequence according to SEQ ID NO: 291 and the antisense strand comprises a modified nucleotide sequence according to SEQ ID NO: 195;

(d) the sense strand comprises a modified nucleotide sequence according to SEQ ID NO: 292 and the antisense strand comprises a modified nucleotide sequence according to SEQ ID NO: 196;

(e) the sense strand comprises a modified nucleotide sequence according to SEQ ID NO: 293 and the antisense strand comprises a modified nucleotide sequence according to SEQ ID NO: 197;

(f) the sense strand comprises a modified nucleotide sequence according to SEQ ID NO: 294 and the antisense strand comprises a modified nucleotide sequence according to SEQ ID NO: 198;

(g) the sense strand comprises a modified nucleotide sequence according to SEQ ID NO: 295 and the antisense strand comprises a modified nucleotide sequence according to SEQ ID NO: 199;

(h) the sense strand comprises a modified nucleotide sequence according to SEQ ID NO: 296 and the antisense strand comprises a modified nucleotide sequence according to SEQ ID NO: 200;

(i) the sense strand comprises a modified nucleotide sequence according to SEQ ID NO: 297 and the antisense strand comprises a modified nucleotide sequence according to SEQ ID NO: 201;

(j) the sense strand comprises a modified nucleotide sequence according to SEQ ID NO: 298 and the antisense strand comprises a modified nucleotide sequence according to SEQ ID NO: 202;

(k) the sense strand comprises a modified nucleotide sequence according to SEQ ID NO: 299 and the antisense strand comprises a modified nucleotide sequence according to SEQ ID NO: 203;

(l) the sense strand comprises a modified nucleotide sequence according to SEQ ID NO: 300 and the antisense strand comprises a modified nucleotide sequence according to SEQ ID NO: 204;

(m) the sense strand comprises a modified nucleotide sequence according to SEQ ID NO: 301 and the antisense strand comprises a modified nucleotide sequence according to SEQ ID NO: 205;

(n) the sense strand comprises a modified nucleotide sequence according to SEQ ID NO: 302 and the antisense strand comprises a modified nucleotide sequence according to SEQ ID NO: 206;

(o) the sense strand comprises a modified nucleotide sequence according to SEQ ID NO: 303 and the antisense strand comprises a modified nucleotide sequence according to SEQ ID NO: 207;

(p) the sense strand comprises a modified nucleotide sequence according to SEQ ID NO: 304 and the antisense strand comprises a modified nucleotide sequence according to SEQ ID NO: 208;

(q) the sense strand comprises a modified nucleotide sequence according to SEQ ID NO: 305 and the antisense strand comprises a modified nucleotide sequence according to SEQ ID NO: 209;

(r) the sense strand comprises a modified nucleotide sequence according to SEQ ID NO: 306 and the antisense strand comprises a modified nucleotide sequence according to SEQ ID NO: 210;

(s) the sense strand comprises a modified nucleotide sequence according to SEQ ID NO: 307 and the antisense strand comprises a modified nucleotide sequence according to SEQ ID NO: 211;

(t) the sense strand comprises a modified nucleotide sequence according to SEQ ID NO: 308 and the antisense strand comprises a modified nucleotide sequence according to SEQ ID NO: 212;

(u) the sense strand comprises a modified nucleotide sequence according to SEQ ID NO: 309 and the antisense strand comprises a modified nucleotide sequence according to SEQ ID NO: 213;

(v) the sense strand comprises a modified nucleotide sequence according to SEQ ID NO: 310 and the antisense strand comprises a modified nucleotide sequence according to SEQ ID NO: 214;

(w) the sense strand comprises a modified nucleotide sequence according to SEQ ID NO: 311 and the antisense strand comprises a modified nucleotide sequence according to SEQ ID NO: 215;

(x) the sense strand comprises a modified nucleotide sequence according to SEQ ID NO: 312 and the antisense strand comprises a modified nucleotide sequence according to SEQ ID NO: 216;

(y) the sense strand comprises a modified nucleotide sequence according to SEQ ID NO: 313 and the antisense strand comprises a modified nucleotide sequence according to SEQ ID NO: 217;

(z) the sense strand comprises a modified nucleotide sequence according to SEQ ID NO: 314 and the antisense strand comprises a modified nucleotide sequence according to SEQ ID NO: 218;

(aa) the sense strand comprises a modified nucleotide sequence according to SEQ ID NO: 315 and the antisense strand comprises a modified nucleotide sequence according to SEQ ID NO: 219;

(bb) the sense strand comprises a modified nucleotide sequence according to SEQ ID NO: 316 and the antisense strand comprises a modified nucleotide sequence according to SEQ ID NO: 220;

(cc) the sense strand comprises a modified nucleotide sequence according to SEQ ID NO: 317 and the antisense strand comprises a modified nucleotide sequence according to SEQ ID NO: 221;

(dd) the sense strand comprises a modified nucleotide sequence according to SEQ ID NO: 318 and the antisense strand comprises a modified nucleotide sequence according to SEQ ID NO: 222;

(ee) the sense strand comprises a modified nucleotide sequence according to SEQ ID NO: 319 and the antisense strand comprises a modified nucleotide sequence according to SEQ ID NO: 223;

(ff) the sense strand comprises a modified nucleotide sequence according to SEQ ID NO: 320 and the antisense strand comprises a modified nucleotide sequence according to SEQ ID NO: 224;

(gg) the sense strand comprises a modified nucleotide sequence according to SEQ ID NO: 321 and the antisense strand comprises a modified nucleotide sequence according to SEQ ID NO: 225;

(hh) the sense strand comprises a modified nucleotide sequence according to SEQ ID NO: 322 and the antisense strand comprises a modified nucleotide sequence according to SEQ ID NO: 226;

(ii) the sense strand comprises a modified nucleotide sequence according to SEQ ID NO: 323 and the antisense strand comprises a modified nucleotide sequence according to SEQ ID NO: 227;

(jj) the sense strand comprises a modified nucleotide sequence according to SEQ ID NO: 324 and the antisense strand comprises a modified nucleotide sequence according to SEQ ID NO: 228;

(kk) the sense strand comprises a modified nucleotide sequence according to SEQ ID NO: 325 and the antisense strand comprises a modified nucleotide sequence according to SEQ ID NO: 229;

(ll) the sense strand comprises a modified nucleotide sequence according to SEQ ID NO: 326 and the antisense strand comprises a modified nucleotide sequence according to SEQ ID NO: 230;

(mm) the sense strand comprises a modified nucleotide sequence according to SEQ ID NO: 327 and the antisense strand comprises a modified nucleotide sequence according to SEQ ID NO: 231;

(nn) the sense strand comprises a modified nucleotide sequence according to SEQ ID NO: 328 and the antisense strand comprises a modified nucleotide sequence according to SEQ ID NO: 232;

(00) the sense strand comprises a modified nucleotide sequence according to SEQ ID NO: 329 and the antisense strand comprises a modified nucleotide sequence according to SEQ ID NO: 233;

(pp) the sense strand comprises a modified nucleotide sequence according to SEQ ID NO: 330 and the antisense strand comprises a modified nucleotide sequence according to SEQ ID NO: 234;

(qq) the sense strand comprises a modified nucleotide sequence according to SEQ ID NO: 331 and the antisense strand comprises a modified nucleotide sequence according to SEQ ID NO: 235;

(rr) the sense strand comprises a modified nucleotide sequence according to SEQ ID NO: 332 and the antisense strand comprises a modified nucleotide sequence according to SEQ ID NO: 236;

(ss) the sense strand comprises a modified nucleotide sequence according to SEQ ID NO: 333 and the antisense strand comprises a modified nucleotide sequence according to SEQ ID NO: 237;

(tt) the sense strand comprises a modified nucleotide sequence according to SEQ ID NO: 334 and the antisense strand comprises a modified nucleotide sequence according to SEQ ID NO: 238;

(uu) the sense strand comprises a modified nucleotide sequence according to SEQ ID NO: 335 and the antisense strand comprises a modified nucleotide sequence according to SEQ ID NO: 239;

(vv) the sense strand comprises a modified nucleotide sequence according to SEQ ID NO: 336 and the antisense strand comprises a modified nucleotide sequence according to SEQ ID NO: 240;

(ww) the sense strand comprises a modified nucleotide sequence according to SEQ ID NO: 337 and the antisense strand comprises a modified nucleotide sequence according to SEQ ID NO: 241;

(xx) the sense strand comprises a modified nucleotide sequence according to SEQ ID NO: 338 and the antisense strand comprises a modified nucleotide sequence according to SEQ ID NO: 242;

(yy) the sense strand comprises a modified nucleotide sequence according to SEQ ID NO: 339 and the antisense strand comprises a modified nucleotide sequence according to SEQ ID NO: 243;

(zz) the sense strand comprises a modified nucleotide sequence according to SEQ ID NO: 340 and the antisense strand comprises a modified nucleotide sequence according to SEQ ID NO: 244;

(aaa) the sense strand comprises a modified nucleotide sequence according to SEQ ID NO: 341 and the antisense strand comprises a modified nucleotide sequence according to SEQ ID NO: 245;

(bbb) the sense strand comprises a modified nucleotide sequence according to SEQ ID NO: 342 and the antisense strand comprises a modified nucleotide sequence according to SEQ ID NO: 246;

(ccc) the sense strand comprises a modified nucleotide sequence according to SEQ ID NO: 343 and the antisense strand comprises a modified nucleotide sequence according to SEQ ID NO: 247;

(ddd) the sense strand comprises a modified nucleotide sequence according to SEQ ID NO: 344 and the antisense strand comprises a modified nucleotide sequence according to SEQ ID NO: 248;

(eee) the sense strand comprises a modified nucleotide sequence according to SEQ ID NO: 345 and the antisense strand comprises a modified nucleotide sequence according to SEQ ID NO: 249;

(fff) the sense strand comprises a modified nucleotide sequence according to SEQ ID NO: 346 and the antisense strand comprises a modified nucleotide sequence according to SEQ ID NO: 250;

(ggg) the sense strand comprises a modified nucleotide sequence according to SEQ ID NO: 347 and the antisense strand comprises a modified nucleotide sequence according to SEQ ID NO: 251;

(hhh) the sense strand comprises a modified nucleotide sequence according to SEQ ID NO: 348 and the antisense strand comprises a modified nucleotide sequence according to SEQ ID NO: 252;

(iii) the sense strand comprises a modified nucleotide sequence according to SEQ ID NO: 349 and the antisense strand comprises a modified nucleotide sequence according to SEQ ID NO: 253;

(jjj) the sense strand comprises a modified nucleotide sequence according to SEQ ID NO: 350 and the antisense strand comprises a modified nucleotide sequence according to SEQ ID NO: 254;

(kkk) the sense strand comprises a modified nucleotide sequence according to SEQ ID NO: 351 and the antisense strand comprises a modified nucleotide sequence according to SEQ ID NO: 255;

(lll) the sense strand comprises a modified nucleotide sequence according to SEQ ID NO: 352 and the antisense strand comprises a modified nucleotide sequence according to SEQ ID NO: 256;

(mmm) the sense strand comprises a modified nucleotide sequence according to SEQ ID NO: 353 and the antisense strand comprises a modified nucleotide sequence according to SEQ ID NO: 257;

(nnn) the sense strand comprises a modified nucleotide sequence according to SEQ ID NO: 354 and the antisense strand comprises a modified nucleotide sequence according to SEQ ID NO: 258;

(ooo) the sense strand comprises a modified nucleotide sequence according to SEQ ID NO: 355 and the antisense strand comprises a modified nucleotide sequence according to SEQ ID NO: 259;

(ppp) the sense strand comprises a modified nucleotide sequence according to SEQ ID NO: 356 and the antisense strand comprises a modified nucleotide sequence according to SEQ ID NO: 260;

(qqq) the sense strand comprises a modified nucleotide sequence according to SEQ ID NO: 357 and the antisense strand comprises a modified nucleotide sequence according to SEQ ID NO: 261;

(rrr) the sense strand comprises a modified nucleotide sequence according to SEQ ID NO: 358 and the antisense strand comprises a modified nucleotide sequence according to SEQ ID NO: 262;

(sss) the sense strand comprises a modified nucleotide sequence according to SEQ ID NO: 359 and the antisense strand comprises a modified nucleotide sequence according to SEQ ID NO: 263;

(ttt) the sense strand comprises a modified nucleotide sequence according to SEQ ID NO: 360 and the antisense strand comprises a modified nucleotide sequence according to SEQ ID NO: 264;

(uuu) the sense strand comprises a modified nucleotide sequence according to SEQ ID NO: 361 and the antisense strand comprises a modified nucleotide sequence according to SEQ ID NO: 265;

(vvv) the sense strand comprises a modified nucleotide sequence according to SEQ ID NO: 362 and the antisense strand comprises a modified nucleotide sequence according to SEQ ID NO: 266;

(www) the sense strand comprises a modified nucleotide sequence according to SEQ ID NO: 363 and the antisense strand comprises a modified nucleotide sequence according to SEQ ID NO: 267;

(xxx) the sense strand comprises a modified nucleotide sequence according to SEQ ID NO: 364 and the antisense strand comprises a modified nucleotide sequence according to SEQ ID NO: 268;

(yyy) the sense strand comprises a modified nucleotide sequence according to SEQ ID NO: 365 and the antisense strand comprises a modified nucleotide sequence according to SEQ ID NO: 269;

(zzz) the sense strand comprises a modified nucleotide sequence according to SEQ ID NO: 366 and the antisense strand comprises a modified nucleotide sequence according to SEQ ID NO: 270;

(aaaa) the sense strand comprises a modified nucleotide sequence according to SEQ ID NO: 367 and the antisense strand comprises a modified nucleotide sequence according to SEQ ID NO: 271;

(bbbb) the sense strand comprises a modified nucleotide sequence according to SEQ ID NO: 368 and the antisense strand comprises a modified nucleotide sequence according to SEQ ID NO: 272;

(cccc) the sense strand comprises a modified nucleotide sequence according to SEQ ID NO: 369 and the antisense strand comprises a modified nucleotide sequence according to SEQ ID NO: 273;

(dddd) the sense strand comprises a modified nucleotide sequence according to SEQ ID NO: 370 and the antisense strand comprises a modified nucleotide sequence according to SEQ ID NO: 274;

(eeee) the sense strand comprises a modified nucleotide sequence according to SEQ ID NO: 371 and the antisense strand comprises a modified nucleotide sequence according to SEQ ID NO: 275;

(ffff) the sense strand comprises a modified nucleotide sequence according to SEQ ID NO: 372 and the antisense strand comprises a modified nucleotide sequence according to SEQ ID NO: 276;

(gggg) the sense strand comprises a modified nucleotide sequence according to SEQ ID NO: 373 and the antisense strand comprises a modified nucleotide sequence according to SEQ ID NO: 277;

(hhhh) the sense strand comprises a modified nucleotide sequence according to SEQ ID NO: 374 and the antisense strand comprises a modified nucleotide sequence according to SEQ ID NO: 278;

(iiii) the sense strand comprises a modified nucleotide sequence according to SEQ ID NO: 375 and the antisense strand comprises a modified nucleotide sequence according to SEQ ID NO: 279;

(jjjj) the sense strand comprises a modified nucleotide sequence according to SEQ ID NO: 376 and the antisense strand comprises a modified nucleotide sequence according to SEQ ID NO: 280;

(kkkk) the sense strand comprises a modified nucleotide sequence according to SEQ ID NO: 377 and the antisense strand comprises a modified nucleotide sequence according to SEQ ID NO: 281;

(llll) the sense strand comprises a modified nucleotide sequence according to SEQ ID NO: 378 and the antisense strand comprises a modified nucleotide sequence according to SEQ ID NO: 282;

(mmmm) the sense strand comprises a modified nucleotide sequence according to SEQ ID NO: 379 and the antisense strand comprises a modified nucleotide sequence according to SEQ ID NO: 283;

(nnnn) the sense strand comprises a modified nucleotide sequence according to SEQ ID NO: 380 and the antisense strand comprises a modified nucleotide sequence according to SEQ ID NO: 284;

(oooo) the sense strand comprises a modified nucleotide sequence according to SEQ ID NO: 381 and the antisense strand comprises a modified nucleotide sequence according to SEQ ID NO: 285;

(pppp) the sense strand comprises a modified nucleotide sequence according to SEQ ID NO: 382 and the antisense strand comprises a modified nucleotide sequence according to SEQ ID NO: 286;

(qqqq) the sense strand comprises a modified nucleotide sequence according to SEQ ID NO: 383 and the antisense strand comprises a modified nucleotide sequence according to SEQ ID NO: 287;

(rrrr) the sense strand comprises a modified nucleotide sequence according to SEQ ID NO: 384 and the antisense strand comprises a modified nucleotide sequence according to SEQ ID NO: 288;

(ssss) the sense strand comprises a modified nucleobase sequence according to SEQ ID NO: 604 and the antisense strand comprises a modified nucleobase sequence according to SEQ ID NO: 531;

(tttt) the sense strand comprises a modified nucleobase sequence according to SEQ ID NO: 605 and the antisense strand comprises a modified nucleobase sequence according to SEQ ID NO: 532;

(uuuu) the sense strand comprises a modified nucleobase sequence according to SEQ ID NO: 606 and the antisense strand comprises a modified nucleobase sequence according to SEQ ID NO: 533;

(vvvv) the sense strand comprises a modified nucleobase sequence according to SEQ ID NO: 607 and the antisense strand comprises a modified nucleobase sequence according to SEQ ID NO: 534;

(wwww) the sense strand comprises a modified nucleobase sequence according to SEQ ID NO: 608 and the antisense strand comprises a modified nucleobase sequence according to SEQ ID NO: 535;

(xxxx) the sense strand comprises a modified nucleobase sequence according to SEQ ID NO: 609 and the antisense strand comprises a modified nucleobase sequence according to SEQ ID NO: 536;

(yyyy) the sense strand comprises a modified nucleobase sequence according to SEQ ID NO: 610 and the antisense strand comprises a modified nucleobase sequence according to SEQ ID NO: 537;

(zzzz) the sense strand comprises a modified nucleobase sequence according to SEQ ID NO: 611 and the antisense strand comprises a modified nucleobase sequence according to SEQ ID NO: 538;

(aaaaa) the sense strand comprises a modified nucleobase sequence according to SEQ ID NO: 612 and the antisense strand comprises a modified nucleobase sequence according to SEQ ID NO: 539;

(bbbbb) the sense strand comprises a modified nucleobase sequence according to SEQ ID NO: 613 and the antisense strand comprises a modified nucleobase sequence according to SEQ ID NO: 540;

(ccccc) the sense strand comprises a modified nucleobase sequence according to SEQ ID NO: 614 and the antisense strand comprises a modified nucleobase sequence according to SEQ ID NO: 541;

(ddddd) the sense strand comprises a modified nucleobase sequence according to SEQ ID NO: 615 and the antisense strand comprises a modified nucleobase sequence according to SEQ ID NO: 542;

(eeeee) the sense strand comprises a modified nucleobase sequence according to SEQ ID NO: 616 and the antisense strand comprises a modified nucleobase sequence according to SEQ ID NO: 543;

(fffff) the sense strand comprises a modified nucleobase sequence according to SEQ ID NO: 617 and the antisense strand comprises a modified nucleobase sequence according to SEQ ID NO: 544;

(ggggg) the sense strand comprises a modified nucleobase sequence according to SEQ ID NO: 618 and the antisense strand comprises a modified nucleobase sequence according to SEQ ID NO: 545;

(hhhhh) the sense strand comprises a modified nucleobase sequence according to SEQ ID NO: 619 and the antisense strand comprises a modified nucleobase sequence according to SEQ ID NO: 546;

(iiiii) the sense strand comprises a modified nucleobase sequence according to SEQ ID NO: 620 and the antisense strand comprises a modified nucleobase sequence according to SEQ ID NO: 547;

(jjjjj) the sense strand comprises a modified nucleobase sequence according to SEQ ID NO: 621 and the antisense strand comprises a modified nucleobase sequence according to SEQ ID NO: 548;

(kkkkk) the sense strand comprises a modified nucleobase sequence according to SEQ ID NO: 622 and the antisense strand comprises a modified nucleobase sequence according to SEQ ID NO: 549;

(lllll) the sense strand comprises a modified nucleobase sequence according to SEQ ID NO: 623 and the antisense strand comprises a modified nucleobase sequence according to SEQ ID NO: 550;

(mmmmm) the sense strand comprises a modified nucleobase sequence according to SEQ ID NO: 624 and the antisense strand comprises a modified nucleobase sequence according to SEQ ID NO: 551;

(nnnnn) the sense strand comprises a modified nucleobase sequence according to SEQ ID NO: 625 and the antisense strand comprises a modified nucleobase sequence according to SEQ ID NO: 552;

(ooooo) the sense strand comprises a modified nucleobase sequence according to SEQ ID NO: 626 and the antisense strand comprises a modified nucleobase sequence according to SEQ ID NO: 553;

(ppppp) the sense strand comprises a modified nucleobase sequence according to SEQ ID NO: 627 and the antisense strand comprises a modified nucleobase sequence according to SEQ ID NO: 554;

(qqqqq) the sense strand comprises a modified nucleobase sequence according to SEQ ID NO: 628 and the antisense strand comprises a modified nucleobase sequence according to SEQ ID NO: 555;

(rrrrr) the sense strand comprises a modified nucleobase sequence according to SEQ ID NO: 629 and the antisense strand comprises a modified nucleobase sequence according to SEQ ID NO: 556;

(sssss) the sense strand comprises a modified nucleobase sequence according to SEQ ID NO: 630 and the antisense strand comprises a modified nucleobase sequence according to SEQ ID NO: 557;

(ttttt) the sense strand comprises a modified nucleobase sequence according to SEQ ID NO: 631 and the antisense strand comprises a modified nucleobase sequence according to SEQ ID NO: 558;

(uuuuu) the sense strand comprises a modified nucleobase sequence according to SEQ ID NO: 632 and the antisense strand comprises a modified nucleobase sequence according to SEQ ID NO: 559;

(vvvvv) the sense strand comprises a modified nucleobase sequence according to SEQ ID NO: 633 and the antisense strand comprises a modified nucleobase sequence according to SEQ ID NO: 560;

(wwwww) the sense strand comprises a modified nucleobase sequence according to SEQ ID NO: 634 and the antisense strand comprises a modified nucleobase sequence according to SEQ ID NO: 561;

(xxxxx) the sense strand comprises a modified nucleobase sequence according to SEQ ID NO: 635 and the antisense strand comprises a modified nucleobase sequence according to SEQ ID NO: 562;

(yyyyy) the sense strand comprises a modified nucleobase sequence according to SEQ ID NO: 636 and the antisense strand comprises a modified nucleobase sequence according to SEQ ID NO: 563;

(zzzzz) the sense strand comprises a modified nucleobase sequence according to SEQ ID NO: 637 and the antisense strand comprises a modified nucleobase sequence according to SEQ ID NO: 564;

(aaaaaa) the sense strand comprises a modified nucleobase sequence according to SEQ ID NO: 638 and the antisense strand comprises a modified nucleobase sequence according to SEQ ID NO: 565;

(bbbbbb) the sense strand comprises a modified nucleobase sequence according to SEQ ID NO: 639 and the antisense strand comprises a modified nucleobase sequence according to SEQ ID NO: 566;

(cccccc) the sense strand comprises a modified nucleobase sequence according to SEQ ID NO: 640 and the antisense strand comprises a modified nucleobase sequence according to SEQ ID NO: 567;

(dddddd) the sense strand comprises a modified nucleobase sequence according to SEQ ID NO: 641 and the antisense strand comprises a modified nucleobase sequence according to SEQ ID NO: 568;

(eeeeee) the sense strand comprises a modified nucleobase sequence according to SEQ ID NO: 642 and the antisense strand comprises a modified nucleobase sequence according to SEQ ID NO: 569;

(ffffff) the sense strand comprises a modified nucleobase sequence according to SEQ ID NO: 643 and the antisense strand comprises a modified nucleobase sequence according to SEQ ID NO: 570;

(gggggg) the sense strand comprises a modified nucleobase sequence according to SEQ ID NO: 644 and the antisense strand comprises a modified nucleobase sequence according to SEQ ID NO: 571;

(hhhhhh) the sense strand comprises a modified nucleobase sequence according to SEQ ID NO: 645 and the antisense strand comprises a modified nucleobase sequence according to SEQ ID NO: 572;

(iiiiii) the sense strand comprises a modified nucleobase sequence according to SEQ ID NO: 646 and the antisense strand comprises a modified nucleobase sequence according to SEQ ID NO: 573;

(jjjjjj) the sense strand comprises a modified nucleobase sequence according to SEQ ID NO: 647 and the antisense strand comprises a modified nucleobase sequence according to SEQ ID NO: 574;

(kkkkkk) the sense strand comprises a modified nucleobase sequence according to SEQ ID NO: 648 and the antisense strand comprises a modified nucleobase sequence according to SEQ ID NO: 575;

(llllll) the sense strand comprises a modified nucleobase sequence according to SEQ ID NO: 649 and the antisense strand comprises a modified nucleobase sequence according to SEQ ID NO: 576;

(mmmmmm) the sense strand comprises a modified nucleobase sequence according to SEQ ID NO: 650 and the antisense strand comprises a modified nucleobase sequence according to SEQ ID NO: 577;

(nnnnnn) the sense strand comprises a modified nucleobase sequence according to SEQ ID NO: 651 and the antisense strand comprises a modified nucleobase sequence according to SEQ ID NO: 578;

(oooooo) the sense strand comprises a modified nucleobase sequence according to SEQ ID NO: 652 and the antisense strand comprises a modified nucleobase sequence according to SEQ ID NO: 579;

(pppppp) the sense strand comprises a modified nucleobase sequence according to SEQ ID NO: 653 and the antisense strand comprises a modified nucleobase sequence according to SEQ ID NO: 580;

(qqqqqq) the sense strand comprises a modified nucleobase sequence according to SEQ ID NO: 654 and the antisense strand comprises a modified nucleobase sequence according to SEQ ID NO: 581;

(rrrrrr) the sense strand comprises a modified nucleobase sequence according to SEQ ID NO: 655 and the antisense strand comprises a modified nucleobase sequence according to SEQ ID NO: 582;

(ssssss) the sense strand comprises a modified nucleobase sequence according to SEQ ID NO: 656 and the antisense strand comprises a modified nucleobase sequence according to SEQ ID NO: 583;

(tttttt) the sense strand comprises a modified nucleobase sequence according to SEQ ID NO: 657 and the antisense strand comprises a modified nucleobase sequence according to SEQ ID NO: 584;

(uuuuuu) the sense strand comprises a modified nucleobase sequence according to SEQ ID NO: 658 and the antisense strand comprises a modified nucleobase sequence according to SEQ ID NO: 585;

(vvvvvv) the sense strand comprises a modified nucleobase sequence according to SEQ ID NO: 659 and the antisense strand comprises a modified nucleobase sequence according to SEQ ID NO: 586;

(wwwwww) the sense strand comprises a modified nucleobase sequence according to SEQ ID NO: 660 and the antisense strand comprises a modified nucleobase sequence according to SEQ ID NO: 587;

(xxxxxx) the sense strand comprises a modified nucleobase sequence according to SEQ ID NO: 661 and the antisense strand comprises a modified nucleobase sequence according to SEQ ID NO: 588;

(yyyyyy) the sense strand comprises a modified nucleobase sequence according to SEQ ID NO: 662 and the antisense strand comprises a modified nucleobase sequence according to SEQ ID NO: 589;

(zzzzzz) the sense strand comprises a modified nucleobase sequence according to SEQ ID NO: 663 and the antisense strand comprises a modified nucleobase sequence according to SEQ ID NO: 590;

(aaaaaaa) the sense strand comprises a modified nucleobase sequence according to SEQ ID NO: 664 and the antisense strand comprises a modified nucleobase sequence according to SEQ ID NO: 591;

(bbbbbbb) the sense strand comprises a modified nucleobase sequence according to SEQ ID NO: 665 and the antisense strand comprises a modified nucleobase sequence according to SEQ ID NO: 592;

(ccccccc) the sense strand comprises a modified nucleobase sequence according to SEQ ID NO: 666 and the antisense strand comprises a modified nucleobase sequence according to SEQ ID NO: 593;

(ddddddd) the sense strand comprises a modified nucleobase sequence according to SEQ ID NO: 667 and the antisense strand comprises a modified nucleobase sequence according to SEQ ID NO: 594;

(eeeeeee) the sense strand comprises a modified nucleobase sequence according to SEQ ID NO: 668 and the antisense strand comprises a modified nucleobase sequence according to SEQ ID NO: 595;

(fffffff) the sense strand comprises a modified nucleobase sequence according to SEQ ID NO: 669 and the antisense strand comprises a modified nucleobase sequence according to SEQ ID NO: 596;

(ggggggg) the sense strand comprises a modified nucleobase sequence according to SEQ ID NO: 670 and the antisense strand comprises a modified nucleobase sequence according to SEQ ID NO: 597;

(hhhhhhh) the sense strand comprises a modified nucleobase sequence according to SEQ ID NO: 671 and the antisense strand comprises a modified nucleobase sequence according to SEQ ID NO: 598;

(iiiiiii) the sense strand comprises a modified nucleobase sequence according to SEQ ID NO: 672 and the antisense strand comprises a modified nucleobase sequence according to SEQ ID NO: 599;

(jjjjjjj) the sense strand comprises a modified nucleobase sequence according to SEQ ID NO: 673 and the antisense strand comprises a modified nucleobase sequence according to SEQ ID NO: 600;

(kkkkkkk) the sense strand comprises a modified nucleobase sequence according to SEQ ID NO: 674 and the antisense strand comprises a modified nucleobase sequence according to SEQ ID NO: 601;

(lllllll) the sense strand comprises a modified nucleobase sequence according to SEQ ID NO: 675 and the antisense strand comprises a modified nucleobase sequence according to SEQ ID NO: 602;

(mmmmmmm) the sense strand comprises a modified nucleobase sequence according to SEQ ID NO: 676 and the antisense strand comprises a modified nucleobase sequence according to SEQ ID NO: 603;

(nnnnnnn) the sense strand comprises a modified nucleobase sequence according to SEQ ID NO: 713 and the antisense strand comprises a modified nucleobase sequence according to SEQ ID NO: 701;

(ooooooo) the sense strand comprises a modified nucleobase sequence according to SEQ ID NO: 714 and the antisense strand comprises a modified nucleobase sequence according to SEQ ID NO: 702;

(ppppppp) the sense strand comprises a modified nucleobase sequence according to SEQ ID NO: 715 and the antisense strand comprises a modified nucleobase sequence according to SEQ ID NO: 703;

(qqqqqqq) the sense strand comprises a modified nucleobase sequence according to SEQ ID NO: 716 and the antisense strand comprises a modified nucleobase sequence according to SEQ ID NO: 704;

(rrrrrrr) the sense strand comprises a modified nucleobase sequence according to SEQ ID NO: 717 and the antisense strand comprises a modified nucleobase sequence according to SEQ ID NO: 705;

(sssssss) the sense strand comprises a modified nucleobase sequence according to SEQ ID NO: 718 and the antisense strand comprises a modified nucleobase sequence according to SEQ ID NO: 706;

(ttttttt) the sense strand comprises a modified nucleobase sequence according to SEQ ID NO: 719 and the antisense strand comprises a modified nucleobase sequence according to SEQ ID NO: 707;

(uuuuuuu) the sense strand comprises a modified nucleobase sequence according to SEQ ID NO: 720 and the antisense strand comprises a modified nucleobase sequence according to SEQ ID NO: 708;

(vvvvvvv) the sense strand comprises a modified nucleobase sequence according to SEQ ID NO: 721 and the antisense strand comprises a modified nucleobase sequence according to SEQ ID NO: 709;

(wwwwwww) the sense strand comprises a modified nucleobase sequence according to SEQ ID NO: 722 and the antisense strand comprises a modified nucleobase sequence according to SEQ ID NO: 710;

(xxxxxxx) the sense strand comprises a modified nucleobase sequence according to SEQ ID NO: 723 and the antisense strand comprises a modified nucleobase sequence according to SEQ ID NO: 711;

(yyyyyyy) the sense strand comprises a modified nucleobase sequence according to SEQ ID NO: 724 and the antisense strand comprises a modified nucleobase sequence according to SEQ ID NO: 712;

(aaaaaaaa) the sense strand comprises a modified nucleobase sequence according to SEQ ID NO: 726 and the antisense strand comprises a modified nucleobase sequence according to SEQ ID NO: 603;

(bbbbbbbb) the sense strand comprises a modified nucleobase sequence according to SEQ ID NO: 727 and the antisense strand comprises a modified nucleobase sequence according to SEQ ID NO: 596;

(cccccccc) the sense strand comprises a modified nucleobase sequence according to SEQ ID NO: 728 and the antisense strand comprises a modified nucleobase sequence according to SEQ ID NO: 703;

(dddddddd) the sense strand comprises a modified nucleobase sequence according to SEQ ID NO: 729 and the antisense strand comprises a modified nucleobase sequence according to SEQ ID NO: 701;

(eeeeeeee) the sense strand comprises a modified nucleobase sequence according to SEQ ID NO: 730 and the antisense strand comprises a modified nucleobase sequence according to SEQ ID NO: 595; or (ffffffff) the sense strand comprises a modified nucleobase sequence according to SEQ ID NO: 731 and the antisense strand comprises a modified nucleobase sequence according to SEQ ID NO: 704.

Embodiment 43. The RNAi agent of embodiment 42, wherein the sense strand comprises a modified nucleotide sequence according to any one of SEQ ID NOS: 668, 669, 676, 713, 715, 716, and 726-731.

Embodiment 47. The RNAi agent of embodiment 46, wherein:

(a) the sense strand comprises a modified nucleobase sequence according to SEQ ID NO: 676 and the antisense strand comprises a modified nucleobase sequence according to SEQ ID NO: 603;

(b) the sense strand comprises a modified nucleobase sequence according to SEQ ID NO: 669 and the antisense strand comprises a modified nucleobase sequence according to SEQ ID NO: 596;

(c) the sense strand comprises a modified nucleobase sequence according to SEQ ID NO: 715 and the antisense strand comprises a modified nucleobase sequence according to SEQ ID NO: 703;

(d) the sense strand comprises a modified nucleobase sequence according to SEQ ID NO: 713 and the antisense strand comprises a modified nucleobase sequence according to SEQ ID NO: 701;

(e) the sense strand comprises a modified nucleobase sequence according to SEQ ID NO: 668 and the antisense strand comprises a modified nucleobase sequence according to SEQ ID NO: 595;

(f) the sense strand comprises a modified nucleobase sequence according to SEQ ID NO: 716 and the antisense strand comprises a modified nucleobase sequence according to SEQ ID NO: 704;

(g) the sense strand comprises a modified nucleobase sequence according to SEQ ID NO: 726 and the antisense strand comprises a modified nucleobase sequence according to SEQ ID NO: 603;

(h) the sense strand comprises a modified nucleobase sequence according to SEQ ID NO: 727 and the antisense strand comprises a modified nucleobase sequence according to SEQ ID NO: 596;

(i) the sense strand comprises a modified nucleobase sequence according to SEQ ID NO: 728 and the antisense strand comprises a modified nucleobase sequence according to SEQ ID NO: 703;

(j) the sense strand comprises a modified nucleobase sequence according to SEQ ID NO: 729 and the antisense strand comprises a modified nucleobase sequence according to SEQ ID NO: 701;

(k) the sense strand comprises a modified nucleobase sequence according to SEQ ID NO: 730 and the antisense strand comprises a modified nucleobase sequence according to SEQ ID NO: 595; or (l) the sense strand comprises a modified nucleobase sequence according to SEQ ID NO: 731 and the antisense strand comprises a modified nucleobase sequence according to SEQ ID NO: 704.

Embodiment 48. The RNAi agent of embodiment 47, wherein the RNAi agent comprises a targeting ligand comprising a structure according to Formula I:

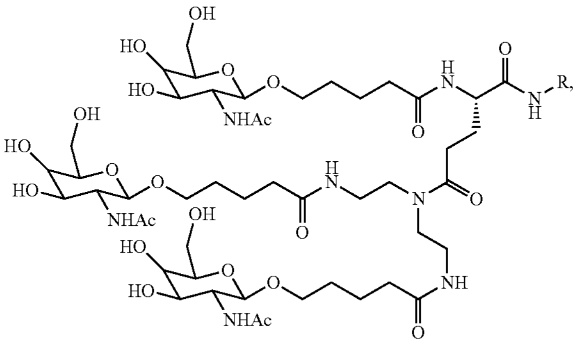

wherein R is a linker conjugated to the wherein the targeting ligand is conjugated to the 3' end of the sense strand, wherein R comprises a structure according to Formula III:

Formula III

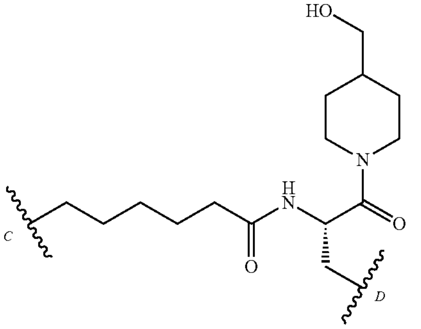

and wherein connection point C of Formula III is conjugated to Formula I, and connection point D of Formula III is conjugated to the 3' end of the sense strand.

Embodiment 49. The RNAi agent of any one of embodiments 1-45, wherein the sense strand comprises a 3' overhang of 1-5 nucleotides in length.

Embodiment 50. The RNAi agent of any one of embodiments 1-45 and 49, wherein the sense strand comprises a 5' overhang of 1-5 nucleotides in length.

Embodiment 51. The RNAi agent of any one of embodiments 1-45, wherein the antisense strand comprises a 3' overhang of 1-5 nucleotides in length.

Embodiment 52. The RNAi agent of any one of embodiments 1-45 and 51, wherein the antisense strand comprises a 5' overhang of 1-5 nucleotides in length.

Embodiment 53. The RNAi agent of any one of embodiments 1-52, wherein the sense strand or the antisense strand comprises at least one modified nucleotide or at least one modified internucleoside linkage.

Embodiment 54. The RNAi agent of embodiment 53, wherein the sense strand and or the antisense strand comprises a modified internucleoside linkage at a first, second, penultimate, or final internucleoside linkage position.

Embodiment 55. The RNAi agent of embodiment 53 or 54, wherein the at least one modified nucleotide or at least one modified internucleoside linkage comprises a 2'-O-methyl modified nucleotide, a nucleotide comprising a 5'-phosphorothioate group, a 2'-deoxy-2'-fluoro modified nucleotide, a 2'-deoxy-modified nucleotide, a locked nucleotide, an abasic nucleotide, deoxythymidine, an inverted deoxythymidine, a 2'-amino-modified nucleotide, a 2'-alkyl-modified nucleotide, a morpholino nucleotide, a phosphoramidate, or a non-natural base comprising nucleotide.

Embodiment 56. The RNAi agent of any one of embodiments 7-47 and 49-55, wherein the targeting ligand is conjugated to the sense strand.

Embodiment 57. The RNAi agent of embodiment 56, wherein the targeting ligand is conjugated to the 3' end of the sense strand.

Embodiment 58. The RNAi agent of embodiment 56, wherein the targeting ligand is conjugated to the 5' end of the sense strand.

Embodiment 59. The RNAi agent of any one of embodiments 7-47 and 49-55, wherein the targeting ligand is conjugated to the antisense strand.

Embodiment 60. The RNAi agent of embodiment 59, wherein the targeting ligand is conjugated to the 3' end of the antisense strand.

Embodiment 61. The RNAi agent of embodiment 59, wherein the targeting ligand is conjugated to the 5' end of the antisense strand.

Embodiment 62. The RNAi agent of any one of embodiments 7-47 and 49-61, wherein the targeting ligand comprises a galactose trimer.

Embodiment 63. The RNAi agent of any one of embodiments 7-47 and 49-62, wherein the targeting ligand comprises N-acetylgalactosamine (GalNac).

Embodiment 64. The RNAi agent of any one of embodiments 7-47 and 49-63, wherein the targeting ligand comprises a structure according to Formula I:

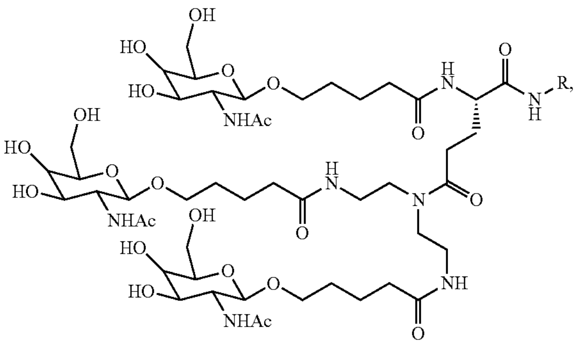

wherein R is:

(i) the sense strand or the antisense strand; or (ii) a linker conjugated to the sense strand or the antisense strand.

Embodiment 65. The RNAi agent of embodiment 64, wherein R is a linker conjugated to the sense strand or the antisense strand having a structure according to Formula III:

Formula III

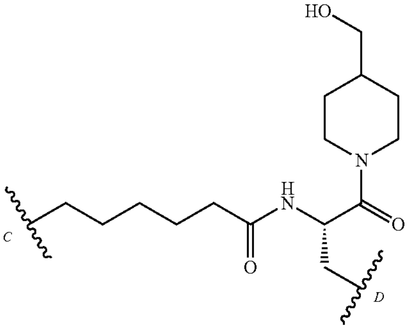

wherein:

(i) connection point C of Formula III is conjugated to Formula I, and connection point D of Formula III is conjugated to the sense strand or the antisense strand; or (ii) connection point C of Formula III is conjugated to Formula I, and connection point D of Formula III is conjugated to a phosphate group which is conjugated to the sense strand or the antisense strand.

Embodiment 66. The RNAi agent of embodiment 65, wherein Formula III or the phosphate group is conjugated to the 3' end or 5' end of the sense strand or the antisense strand.

Embodiment 67. The RNAi agent of embodiment 65, wherein Formula III or the phosphate group is conjugated to an internal nucleotide or nucleoside base of the sense strand or the antisense strand.

Embodiment 68. The RNAi agent of any one of embodiments 7-47 and 49-63, wherein the RNAi agent comprises a targeting ligand and linker according to Formula V:

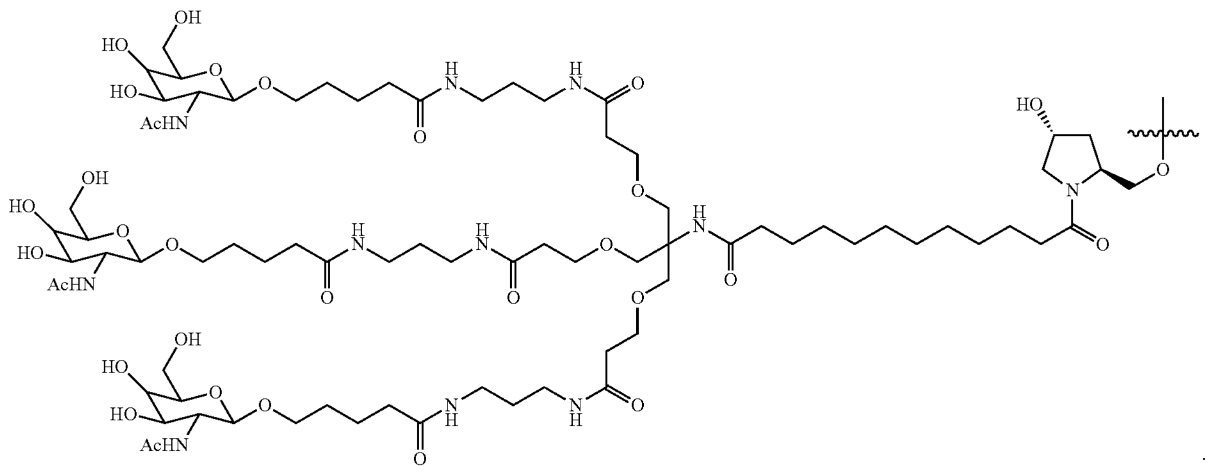 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

Embodiment 69. The RNAi agent of any one of embodiments 1-68, wherein the RNAi agent is an siRNA molecule.

Embodiment 70. The RNAi agent of any one of embodiments 1-68, wherein the RNAi agent is an shRNA molecule.

Embodiment 71. A modified oligonucleotide consisting of 12 to 30 or 12 to 50 linked nucleosides, wherein the modified oligonucleotide has a nucleobase sequence comprising at least 12, at least 13, at least 14, at least 15, at least 16, at least 17, at least 18, at least 19, at least 20, at least 21, at least 22, at least 23, at least 24, or at least 25 contiguous nucleobases complementary to an equal length portion of SEQ ID NO: 725, and wherein the modified oligonucleotide comprises at least one synthetically modified internucleoside linkage or at least one synthetically modified sugar-phosphate backbone.

Embodiment 72. The modified oligonucleotide of embodiment 71, wherein the modified oligonucleotide comprises a synthetically modified internucleoside linkage at a first, second, penultimate, or final internucleoside linkage position.

Embodiment 73. The modified oligonucleotide of embodiment 71 or 72, wherein the modified oligonucleotide comprises a 2'-O-methyl modified nucleotide, a nucleotide comprising a 5'-phosphorothioate group, a 2'-deoxy-2'-fluoro modified nucleotide, a 2'-deoxy-modified nucleotide, a locked nucleotide, an abasic nucleotide, deoxythymidine, an inverted deoxythymidine, a 2'-amino-modified nucleotide, a 2'-alkyl-modified nucleotide, a morpholino nucleotide, a phosphoramidate, or a non-natural base comprising nucleotide.

Embodiment 74. The modified oligonucleotide of any one of embodiments 71-73, wherein the modified oligonucleotide or a subsequence thereof differs by 0, 1, 2, 3, or 4 nucleotides from an equal length portion of any one of SEQ ID NOS: 193-288, 531-603, and 701-712, wherein the subsequence is at least 14, 15, 16, 17, 18, 19, 20, or 21 bases in length.

Embodiment 75. The modified oligonucleotide of any one of embodiments 71-74, wherein the modified oligonucleotide comprises, in order, nucleotides 2-23 of any one of SEQ ID NOS: 193-288, 531-603, and 701-712.

Embodiment 76. The modified oligonucleotide of any one of embodiments 71-75, wherein the modified oligonucleotide comprises a modified nucleotide sequence according to any one of SEQ ID NOS: 193-288, 531-603, and 701-712.

Embodiment 77. The modified oligonucleotide of any one of embodiments 71-76, wherein the modified oligonucleotide is conjugated to a targeting ligand that targets a hepatocyte.

Embodiment 78. The modified oligonucleotide of embodiment 77, wherein the modified oligonucleotide is conjugated to the targeting ligand conjugated to its 3' end.

Embodiment 79. The modified oligonucleotide of embodiment 77, wherein the modified oligonucleotide is conjugated to the targeting ligand conjugated to its 5' end.

Embodiment 80. The modified oligonucleotide of any one of embodiments 77-79, wherein the targeting ligand comprises a galactose trimer.

Embodiment 81. The modified oligonucleotide of any one of embodiments 77-80, wherein the targeting ligand comprises N-acetylgalactosamine (GalNac).

Embodiment 82. The modified oligonucleotide of any one of embodiments 77-81, wherein the targeting ligand comprises a structure according to Formula I:

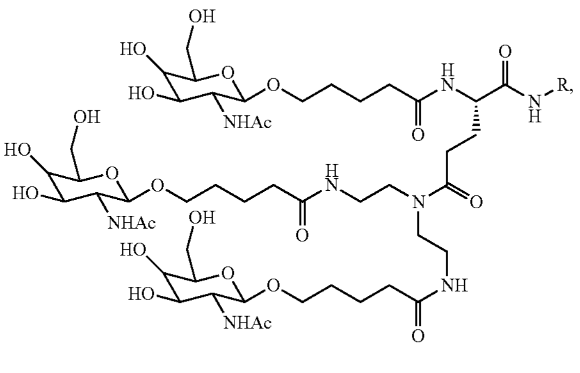

wherein R is:

(i) the modified oligonucleotide; or (ii) a linker conjugated to the modified oligonucleotide.

Embodiment 83. The modified oligonucleotide of embodiment 82, wherein R is a linker conjugated to the modified oligonucleotide having a structure according to Formula III:

Formula III

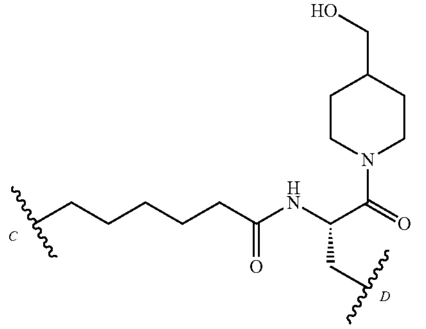

wherein:

(i) connection point C of Formula III is conjugated to Formula I, and connection point D of Formula III is conjugated to the modified oligonucleotide; or (ii) connection point C of Formula III is conjugated to Formula I, and connection point D of Formula III is conjugated to a phosphate group which is conjugated to the modified oligonucleotide.

Embodiment 84. The modified oligonucleotide of embodiment 83, wherein Formula III or the phosphate group is conjugated to the 3' end or 5' end of the modified oligonucleotide.

Embodiment 85. The modified oligonucleotide of embodiment 83, wherein Formula III or the phosphate group is conjugated to an internal nucleotide or nucleoside base of the modified oligonucleotide.

Embodiment 86. The modified oligonucleotide of any one of embodiments 77-81, wherein the modified oligonucleotide comprises a targeting ligand and linker according to Formula V:

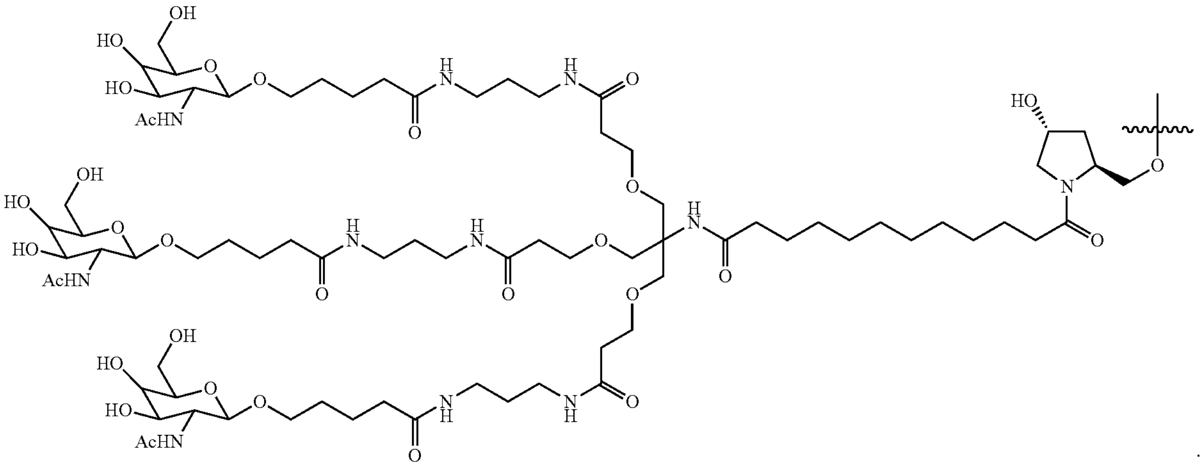 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

.

Embodiment 87. The modified oligonucleotide of any one of embodiments 71-86, wherein the modified oligonucleotide is an siRNA molecule.

Embodiment 88. The modified oligonucleotide of any one of embodiments 71-86, wherein the modified oligonucleotide is an shRNA molecule.

Embodiment 89. An oligomeric duplex comprising:

(a) a first modified oligonucleotide consisting of 12 to 30 or 12 to 50 linked nucleosides, wherein a nucleobase sequence of the first modified oligonucleotide comprises at least 12, at least 13, at least 14, at least 15, at least 16, at least 17, at least 18, at least 19, at least 20, at least 21, at least 22, at least 23, at least 24, or at least 25 contiguous nucleobases complementary to an equal length portion of SEQ ID NO: 725; and (b) a second modified oligonucleotide consisting of 12 to 30 or 12 to 50 linked nucleosides, wherein a nucleobase sequence of the second modified oligonucleotide comprises a complementary region of at least 8 nucleobases that is at least 90% complementary to the nucleobase sequence of an equal length portion of the first modified oligonucleotide.

Embodiment 90. The oligomeric duplex of embodiment 89, wherein the first modified oligonucleotide and/or second modified oligonucleotide comprises at least one synthetically modified internucleoside linkage or at least one synthetically modified sugar-phosphate backbone.

Embodiment 91. The oligomeric duplex of any one of embodiments 89-90, wherein the first modified oligonucleotide and/or the second comprises a 2'-O-methyl modified nucleotide, a nucleotide comprising a 5'-phosphorothioate group, a 2'-deoxy-2'-fluoro modified nucleotide, a 2'-deoxy-modified nucleotide, a locked nucleotide, an abasic nucleotide, deoxythymidine, an inverted deoxythymidine, a 2'-amino-modified nucleotide, a 2'-alkyl-modified nucleotide, a morpholino nucleotide, a phosphoramidate, or a non-natural base comprising nucleotide.

Embodiment 92. The oligomeric duplex of any one of embodiments 89-91, wherein the first modified oligonucleotide or a subsequence thereof differs by 0, 1, 2, 3, or 4 nucleotides from an equal length portion of any one of SEQ ID NOS: 193-288, 531-603, and 701-712, wherein the subsequence is at least 14, 15, 16, 17, 18, 19, 20, or 21 bases in length.

Embodiment 93. The oligomeric duplex of any one of embodiments 89-92, wherein the first modified oligonucleotide comprises, in order, nucleotides 2-23 of any one of SEQ ID NOS: 193-288, 531-603, and 701-712.

Embodiment 94. The oligomeric duplex of any one of embodiments 89-92, wherein the first modified oligonucleotide comprises a modified nucleotide sequence according to any one of SEQ ID NOS: 193-288, 531-603, and 701-712.

Embodiment 95. The oligomeric duplex of embodiment 94, wherein the first modified oligonucleotide comprises a modified nucleotide sequence according to any one of SEQ ID NOS: 595, 596, 603, 701, 703, and 704.

Embodiment 96. The oligomeric duplex of any one of embodiments 89-95, wherein the second modified oligonucleotide or a subsequence thereof differs by 0, 1, 2, 3, or 4 nucleotides from an equal length portion of any one of SEQ ID NOS: 289-384, 604-676, 713-724, and 726-731, wherein the subsequence is at least 14, 15, 16, 17, 18, 19, 20, or 21 bases in length.

Embodiment 97. The oligomeric duplex of any one of embodiments 89-96, wherein the second modified oligonucleotide comprises, in order, nucleotides 1-22 of any one of SEQ ID NOS: 289-384, 604-676, 713-724, and 726-731.

Embodiment 98. The oligomeric duplex of any one of embodiments 89-97, wherein the second modified oligonucleotide comprises a modified nucleotide sequence according to any one of SEQ ID NOS: 289-384, 604-676, 713-724, and 726-731.

Embodiment 99. The oligomeric duplex of embodiment 98, wherein the second modified oligonucleotide comprises a modified nucleotide sequence according to any one of SEQ ID NOS: 522, 523, 530, 689, 691, 692, and 726-731.

Embodiment 100. The oligomeric duplex of any one of embodiments 89-99, wherein:

(a) the second modified oligonucleotide comprises a modified nucleotide sequence according to SEQ ID NO: 289 and the first modified oligonucleotide comprises a modified nucleotide sequence according to SEQ ID NO: 193;

(b) the second modified oligonucleotide comprises a modified nucleotide sequence according to SEQ ID NO: 290 and the first modified oligonucleotide comprises a modified nucleotide sequence according to SEQ ID NO: 194;

(c) the second modified oligonucleotide comprises a modified nucleotide sequence according to SEQ ID NO: 291 and the first modified oligonucleotide comprises a modified nucleotide sequence according to SEQ ID NO: 195;

(d) the second modified oligonucleotide comprises a modified nucleotide sequence according to SEQ ID NO: 292 and the first modified oligonucleotide comprises a modified nucleotide sequence according to SEQ ID NO: 196;

(e) the second modified oligonucleotide comprises a modified nucleotide sequence according to SEQ ID NO: 293 and the first modified oligonucleotide comprises a modified nucleotide sequence according to SEQ ID NO: 197;

(f) the second modified oligonucleotide comprises a modified nucleotide sequence according to SEQ ID NO: 294 and the first modified oligonucleotide comprises a modified nucleotide sequence according to SEQ ID NO: 198;

(g) the second modified oligonucleotide comprises a modified nucleotide sequence according to SEQ ID NO: 295 and the first modified oligonucleotide comprises a modified nucleotide sequence according to SEQ ID NO: 199;

(h) the second modified oligonucleotide comprises a modified nucleotide sequence according to SEQ ID NO: 296 and the first modified oligonucleotide comprises a modified nucleotide sequence according to SEQ ID NO: 200;

(i) the second modified oligonucleotide comprises a modified nucleotide sequence according to SEQ ID NO: 297 and the first modified oligonucleotide comprises a modified nucleotide sequence according to SEQ ID NO: 201;

(j) the second modified oligonucleotide comprises a modified nucleotide sequence according to SEQ ID NO: 298 and the first modified oligonucleotide comprises a modified nucleotide sequence according to SEQ ID NO: 202;

(k) the second modified oligonucleotide comprises a modified nucleotide sequence according to SEQ ID NO: 299 and the first modified oligonucleotide comprises a modified nucleotide sequence according to SEQ ID NO: 203;

(l) the second modified oligonucleotide comprises a modified nucleotide sequence according to SEQ ID NO: 300 and the first modified oligonucleotide comprises a modified nucleotide sequence according to SEQ ID NO: 204;

(m) the second modified oligonucleotide comprises a modified nucleotide sequence according to SEQ ID NO: 301 and the first modified oligonucleotide comprises a modified nucleotide sequence according to SEQ ID NO: 205;

(n) the second modified oligonucleotide comprises a modified nucleotide sequence according to SEQ ID NO: 302 and the first modified oligonucleotide comprises a modified nucleotide sequence according to SEQ ID NO: 206;

(o) the second modified oligonucleotide comprises a modified nucleotide sequence according to SEQ ID NO: 303 and the first modified oligonucleotide comprises a modified nucleotide sequence according to SEQ ID NO: 207;

(p) the second modified oligonucleotide comprises a modified nucleotide sequence according to SEQ ID NO: 304 and the first modified oligonucleotide comprises a modified nucleotide sequence according to SEQ ID NO: 208;

(q) the second modified oligonucleotide comprises a modified nucleotide sequence according to SEQ ID NO: 305 and the first modified oligonucleotide comprises a modified nucleotide sequence according to SEQ ID NO: 209;

(r) the second modified oligonucleotide comprises a modified nucleotide sequence according to SEQ ID NO: 306 and the first modified oligonucleotide comprises a modified nucleotide sequence according to SEQ ID NO: 210;

(s) the second modified oligonucleotide comprises a modified nucleotide sequence according to SEQ ID NO: 307 and the first modified oligonucleotide comprises a modified nucleotide sequence according to SEQ ID NO: 211;

(t) the second modified oligonucleotide comprises a modified nucleotide sequence according to SEQ ID NO: 308 and the first modified oligonucleotide comprises a modified nucleotide sequence according to SEQ ID NO: 212;

(u) the second modified oligonucleotide comprises a modified nucleotide sequence according to SEQ ID NO: 309 and the first modified oligonucleotide comprises a modified nucleotide sequence according to SEQ ID NO: 213;

(v) the second modified oligonucleotide comprises a modified nucleotide sequence according to SEQ ID NO: 310 and the first modified oligonucleotide comprises a modified nucleotide sequence according to SEQ ID NO: 214;

(w) the second modified oligonucleotide comprises a modified nucleotide sequence according to SEQ ID NO: 311 and the first modified oligonucleotide comprises a modified nucleotide sequence according to SEQ ID NO: 215;

(x) the second modified oligonucleotide comprises a modified nucleotide sequence according to SEQ ID NO: 312 and the first modified oligonucleotide comprises a modified nucleotide sequence according to SEQ ID NO: 216;

(y) the second modified oligonucleotide comprises a modified nucleotide sequence according to SEQ ID NO: 313 and the first modified oligonucleotide comprises a modified nucleotide sequence according to SEQ ID NO: 217;

(z) the second modified oligonucleotide comprises a modified nucleotide sequence according to SEQ ID NO: 314 and the first modified oligonucleotide comprises a modified nucleotide sequence according to SEQ ID NO: 218;

(aa) the second modified oligonucleotide comprises a modified nucleotide sequence according to SEQ ID NO: 315 and the first modified oligonucleotide comprises a modified nucleotide sequence according to SEQ ID NO: 219;

(bb) the second modified oligonucleotide comprises a modified nucleotide sequence according to SEQ ID NO: 316 and the first modified oligonucleotide comprises a modified nucleotide sequence according to SEQ ID NO: 220;

(cc) the second modified oligonucleotide comprises a modified nucleotide sequence according to SEQ ID NO: 317 and the first modified oligonucleotide comprises a modified nucleotide sequence according to SEQ ID NO: 221;

(dd) the second modified oligonucleotide comprises a modified nucleotide sequence according to SEQ ID NO: 318 and the first modified oligonucleotide comprises a modified nucleotide sequence according to SEQ ID NO: 222;

(ee) the second modified oligonucleotide comprises a modified nucleotide sequence according to SEQ ID NO: 319 and the first modified oligonucleotide comprises a modified nucleotide sequence according to SEQ ID NO: 223;

(ff) the second modified oligonucleotide comprises a modified nucleotide sequence according to SEQ ID NO: 320 and the first modified oligonucleotide comprises a modified nucleotide sequence according to SEQ ID NO: 224;

(gg) the second modified oligonucleotide comprises a modified nucleotide sequence according to SEQ ID NO: 321 and the first modified oligonucleotide comprises a modified nucleotide sequence according to SEQ ID NO: 225;

(hh) the second modified oligonucleotide comprises a modified nucleotide sequence according to SEQ ID NO: 322 and the first modified oligonucleotide comprises a modified nucleotide sequence according to SEQ ID NO: 226;

(ii) the second modified oligonucleotide comprises a modified nucleotide sequence according to SEQ ID NO: 323 and the first modified oligonucleotide comprises a modified nucleotide sequence according to SEQ ID NO: 227;

(jj) the second modified oligonucleotide comprises a modified nucleotide sequence according to SEQ ID NO: 324 and the first modified oligonucleotide comprises a modified nucleotide sequence according to SEQ ID NO: 228;

(kk) the second modified oligonucleotide comprises a modified nucleotide sequence according to SEQ ID NO: 325 and the first modified oligonucleotide comprises a modified nucleotide sequence according to SEQ ID NO: 229;

(ll) the second modified oligonucleotide comprises a modified nucleotide sequence according to SEQ ID NO: 326 and the first modified oligonucleotide comprises a modified nucleotide sequence according to SEQ ID NO: 230;

(mm) the second modified oligonucleotide comprises a modified nucleotide sequence according to SEQ ID NO: 327 and the first modified oligonucleotide comprises a modified nucleotide sequence according to SEQ ID NO: 231;

(nn) the second modified oligonucleotide comprises a modified nucleotide sequence according to SEQ ID NO: 328 and the first modified oligonucleotide comprises a modified nucleotide sequence according to SEQ ID NO: 232;

(oo) the second modified oligonucleotide comprises a modified nucleotide sequence according to SEQ ID NO: 329 and the first modified oligonucleotide comprises a modified nucleotide sequence according to SEQ ID NO: 233;

(pp) the second modified oligonucleotide comprises a modified nucleotide sequence according to SEQ ID NO: 330 and the first modified oligonucleotide comprises a modified nucleotide sequence according to SEQ ID NO: 234;

(qq) the second modified oligonucleotide comprises a modified nucleotide sequence according to SEQ ID NO: 331 and the first modified oligonucleotide comprises a modified nucleotide sequence according to SEQ ID NO: 235;

(rr) the second modified oligonucleotide comprises a modified nucleotide sequence according to SEQ ID NO: 332 and the first modified oligonucleotide comprises a modified nucleotide sequence according to SEQ ID NO: 236;

(ss) the second modified oligonucleotide comprises a modified nucleotide sequence according to SEQ ID NO: 333 and the first modified oligonucleotide comprises a modified nucleotide sequence according to SEQ ID NO: 237;

(tt) the second modified oligonucleotide comprises a modified nucleotide sequence according to SEQ ID NO: 334 and the first modified oligonucleotide comprises a modified nucleotide sequence according to SEQ ID NO: 238;

(uu) the second modified oligonucleotide comprises a modified nucleotide sequence according to SEQ ID NO: 335 and the first modified oligonucleotide comprises a modified nucleotide sequence according to SEQ ID NO: 239;

(vv) the second modified oligonucleotide comprises a modified nucleotide sequence according to SEQ ID NO: 336 and the first modified oligonucleotide comprises a modified nucleotide sequence according to SEQ ID NO: 240;

(ww) the second modified oligonucleotide comprises a modified nucleotide sequence according to SEQ ID NO: 337 and the first modified oligonucleotide comprises a modified nucleotide sequence according to SEQ ID NO: 241;

(xx) the second modified oligonucleotide comprises a modified nucleotide sequence according to SEQ ID NO: 338 and the first modified oligonucleotide comprises a modified nucleotide sequence according to SEQ ID NO: 242;

(yy) the second modified oligonucleotide comprises a modified nucleotide sequence according to SEQ ID NO: 339 and the first modified oligonucleotide comprises a modified nucleotide sequence according to SEQ ID NO: 243;

(zz) the second modified oligonucleotide comprises a modified nucleotide sequence according to SEQ ID NO: 340 and the first modified oligonucleotide comprises a modified nucleotide sequence according to SEQ ID NO: 244;

(aaa) the second modified oligonucleotide comprises a modified nucleotide sequence according to SEQ ID NO: 341 and the first modified oligonucleotide comprises a modified nucleotide sequence according to SEQ ID NO: 245;

(bbb) the second modified oligonucleotide comprises a modified nucleotide sequence according to SEQ ID NO: 342 and the first modified oligonucleotide comprises a modified nucleotide sequence according to SEQ ID NO: 246;

(ccc) the second modified oligonucleotide comprises a modified nucleotide sequence according to SEQ ID NO: 343 and the first modified oligonucleotide comprises a modified nucleotide sequence according to SEQ ID NO: 247;

(ddd) the second modified oligonucleotide comprises a modified nucleotide sequence according to SEQ ID NO: 344 and the first modified oligonucleotide comprises a modified nucleotide sequence according to SEQ ID NO: 248;

(eee) the second modified oligonucleotide comprises a modified nucleotide sequence according to SEQ ID NO: 345 and the first modified oligonucleotide comprises a modified nucleotide sequence according to SEQ ID NO: 249;

(fff) the second modified oligonucleotide comprises a modified nucleotide sequence according to SEQ ID NO: 346 and the first modified oligonucleotide comprises a modified nucleotide sequence according to SEQ ID NO: 250;

(ggg) the second modified oligonucleotide comprises a modified nucleotide sequence according to SEQ ID NO: 347 and the first modified oligonucleotide comprises a modified nucleotide sequence according to SEQ ID NO: 251;

(hhh) the second modified oligonucleotide comprises a modified nucleotide sequence according to SEQ ID NO: 348 and the first modified oligonucleotide comprises a modified nucleotide sequence according to SEQ ID NO: 252;

(iii) the second modified oligonucleotide comprises a modified nucleotide sequence according to SEQ ID NO: 349 and the first modified oligonucleotide comprises a modified nucleotide sequence according to SEQ ID NO: 253;

(jjj) the second modified oligonucleotide comprises a modified nucleotide sequence according to SEQ ID NO: 350 and the first modified oligonucleotide comprises a modified nucleotide sequence according to SEQ ID NO: 254;

(kkk) the second modified oligonucleotide comprises a modified nucleotide sequence according to SEQ ID NO: 351 and the first modified oligonucleotide comprises a modified nucleotide sequence according to SEQ ID NO: 255;

(lll) the second modified oligonucleotide comprises a modified nucleotide sequence according to SEQ ID NO: 352 and the first modified oligonucleotide comprises a modified nucleotide sequence according to SEQ ID NO: 256;

(mmm) the second modified oligonucleotide comprises a modified nucleotide sequence according to SEQ ID NO: 353 and the first modified oligonucleotide comprises a modified nucleotide sequence according to SEQ ID NO: 257;

(nnn) the second modified oligonucleotide comprises a modified nucleotide sequence according to SEQ ID NO: 354 and the first modified oligonucleotide comprises a modified nucleotide sequence according to SEQ ID NO: 258;

(ooo) the second modified oligonucleotide comprises a modified nucleotide sequence according to SEQ ID NO: 355 and the first modified oligonucleotide comprises a modified nucleotide sequence according to SEQ ID NO: 259;

(ppp) the second modified oligonucleotide comprises a modified nucleotide sequence according to SEQ ID NO: 356 and the first modified oligonucleotide comprises a modified nucleotide sequence according to SEQ ID NO: 260;

(qqq) the second modified oligonucleotide comprises a modified nucleotide sequence according to SEQ ID NO: 357 and the first modified oligonucleotide comprises a modified nucleotide sequence according to SEQ ID NO: 261;

(rrr) the second modified oligonucleotide comprises a modified nucleotide sequence according to SEQ ID NO: 358 and the first modified oligonucleotide comprises a modified nucleotide sequence according to SEQ ID NO: 262;

(sss) the second modified oligonucleotide comprises a modified nucleotide sequence according to SEQ ID NO: 359 and the first modified oligonucleotide comprises a modified nucleotide sequence according to SEQ ID NO: 263;

(ttt) the second modified oligonucleotide comprises a modified nucleotide sequence according to SEQ ID NO: 360 and the first modified oligonucleotide comprises a modified nucleotide sequence according to SEQ ID NO: 264;

(uuu) the second modified oligonucleotide comprises a modified nucleotide sequence according to SEQ ID NO: 361 and the first modified oligonucleotide comprises a modified nucleotide sequence according to SEQ ID NO: 265;

(vvv) the second modified oligonucleotide comprises a modified nucleotide sequence according to SEQ ID NO: 362 and the first modified oligonucleotide comprises a modified nucleotide sequence according to SEQ ID NO: 266;

(www) the second modified oligonucleotide comprises a modified nucleotide sequence according to SEQ ID NO: 363 and the first modified oligonucleotide comprises a modified nucleotide sequence according to SEQ ID NO: 267;

(xxx) the second modified oligonucleotide comprises a modified nucleotide sequence according to SEQ ID NO: 364 and the first modified oligonucleotide comprises a modified nucleotide sequence according to SEQ ID NO: 268;

(yyy) the second modified oligonucleotide comprises a modified nucleotide sequence according to SEQ ID NO: 365 and the first modified oligonucleotide comprises a modified nucleotide sequence according to SEQ ID NO: 269;

(zzz) the second modified oligonucleotide comprises a modified nucleotide sequence according to SEQ ID NO: 366 and the first modified oligonucleotide comprises a modified nucleotide sequence according to SEQ ID NO: 270;

(aaaa) the second modified oligonucleotide comprises a modified nucleotide sequence according to SEQ ID NO: 367 and the first modified oligonucleotide comprises a modified nucleotide sequence according to SEQ ID NO: 271;

(bbbb) the second modified oligonucleotide comprises a modified nucleotide sequence according to SEQ ID NO: 368 and the first modified oligonucleotide comprises a modified nucleotide sequence according to SEQ ID NO: 272;

(cccc) the second modified oligonucleotide comprises a modified nucleotide sequence according to SEQ ID NO: 369 and the first modified oligonucleotide comprises a modified nucleotide sequence according to SEQ ID NO: 273;

(dddd) the second modified oligonucleotide comprises a modified nucleotide sequence according to SEQ ID NO: 370 and the first modified oligonucleotide comprises a modified nucleotide sequence according to SEQ ID NO: 274;

(eeee) the second modified oligonucleotide comprises a modified nucleotide sequence according to SEQ ID NO: 371 and the first modified oligonucleotide comprises a modified nucleotide sequence according to SEQ ID NO: 275;

(ffff) the second modified oligonucleotide comprises a modified nucleotide sequence according to SEQ ID NO: 372 and the first modified oligonucleotide comprises a modified nucleotide sequence according to SEQ ID NO: 276;

(gggg) the second modified oligonucleotide comprises a modified nucleotide sequence according to SEQ ID NO: 373 and the first modified oligonucleotide comprises a modified nucleotide sequence according to SEQ ID NO: 277;

(hhhh) the second modified oligonucleotide comprises a modified nucleotide sequence according to SEQ ID NO: 374 and the first modified oligonucleotide comprises a modified nucleotide sequence according to SEQ ID NO: 278;

(iiii) the second modified oligonucleotide comprises a modified nucleotide sequence according to SEQ ID NO: 375 and the first modified oligonucleotide comprises a modified nucleotide sequence according to SEQ ID NO: 279;

(jjjj) the second modified oligonucleotide comprises a modified nucleotide sequence according to SEQ ID NO: 376 and the first modified oligonucleotide comprises a modified nucleotide sequence according to SEQ ID NO: 280;

(kkkk) the second modified oligonucleotide comprises a modified nucleotide sequence according to SEQ ID NO: 377 and the first modified oligonucleotide comprises a modified nucleotide sequence according to SEQ ID NO: 281;

(llll) the second modified oligonucleotide comprises a modified nucleotide sequence according to SEQ ID NO: 378 and the first modified oligonucleotide comprises a modified nucleotide sequence according to SEQ ID NO: 282;

(mmmm) the second modified oligonucleotide comprises a modified nucleotide sequence according to SEQ ID NO: 379 and the first modified oligonucleotide comprises a modified nucleotide sequence according to SEQ ID NO: 283;

(nnnn) the second modified oligonucleotide comprises a modified nucleotide sequence according to SEQ ID NO: 380 and the first modified oligonucleotide comprises a modified nucleotide sequence according to SEQ ID NO: 284;

(oooo) the second modified oligonucleotide comprises a modified nucleotide sequence according to SEQ ID NO: 381 and the first modified oligonucleotide comprises a modified nucleotide sequence according to SEQ ID NO: 285;

(pppp) the second modified oligonucleotide comprises a modified nucleotide sequence according to SEQ ID NO: 382 and the first modified oligonucleotide comprises a modified nucleotide sequence according to SEQ ID NO: 286;

(qqqq) the second modified oligonucleotide comprises a modified nucleotide sequence according to SEQ ID NO: 383 and the first modified oligonucleotide comprises a modified nucleotide sequence according to SEQ ID NO: 287;

(rrrr) the second modified oligonucleotide comprises a modified nucleotide sequence according to SEQ ID NO: 384 and the first modified oligonucleotide comprises a modified nucleotide sequence according to SEQ ID NO: 288;

(ssss) the second modified oligonucleotide comprises a modified nucleobase sequence according to SEQ ID NO: 604 and the first modified oligonucleotide comprises a modified nucleobase sequence according to SEQ ID NO: 531;

(tttt) the second modified oligonucleotide comprises a modified nucleobase sequence according to SEQ ID NO: 605 and the first modified oligonucleotide comprises a modified nucleobase sequence according to SEQ ID NO: 532;

(uuuu) the second modified oligonucleotide comprises a modified nucleobase sequence according to SEQ ID NO: 606 and the first modified oligonucleotide comprises a modified nucleobase sequence according to SEQ ID NO: 533;

(vvvv) the second modified oligonucleotide comprises a modified nucleobase sequence according to SEQ ID NO: 607 and the first modified oligonucleotide comprises a modified nucleobase sequence according to SEQ ID NO: 534;

(wwww) the second modified oligonucleotide comprises a modified nucleobase sequence according to SEQ ID NO: 608 and the first modified oligonucleotide comprises a modified nucleobase sequence according to SEQ ID NO: 535;

(xxxx) the second modified oligonucleotide comprises a modified nucleobase sequence according to SEQ ID NO: 609 and the first modified oligonucleotide comprises a modified nucleobase sequence according to SEQ ID NO: 536;

(yyyy) the second modified oligonucleotide comprises a modified nucleobase sequence according to SEQ ID NO: 610 and the first modified oligonucleotide comprises a modified nucleobase sequence according to SEQ ID NO: 537;

(zzzz) the second modified oligonucleotide comprises a modified nucleobase sequence according to SEQ ID NO: 611 and the first modified oligonucleotide comprises a modified nucleobase sequence according to SEQ ID NO: 538;

(aaaaa) the second modified oligonucleotide comprises a modified nucleobase sequence according to SEQ ID NO: 612 and the first modified oligonucleotide comprises a modified nucleobase sequence according to SEQ ID NO: 539;

(bbbbb) the second modified oligonucleotide comprises a modified nucleobase sequence according to SEQ ID NO: 613 and the first modified oligonucleotide comprises a modified nucleobase sequence according to SEQ ID NO: 540;

(ccccc) the second modified oligonucleotide comprises a modified nucleobase sequence according to SEQ ID NO: 614 and the first modified oligonucleotide comprises a modified nucleobase sequence according to SEQ ID NO: 541;

(ddddd) the second modified oligonucleotide comprises a modified nucleobase sequence according to SEQ ID NO: 615 and the first modified oligonucleotide comprises a modified nucleobase sequence according to SEQ ID NO: 542;

(eeeee) the second modified oligonucleotide comprises a modified nucleobase sequence according to SEQ ID NO: 616 and the first modified oligonucleotide comprises a modified nucleobase sequence according to SEQ ID NO: 543;

(fffff) the second modified oligonucleotide comprises a modified nucleobase sequence according to SEQ ID NO: 617 and the first modified oligonucleotide comprises a modified nucleobase sequence according to SEQ ID NO: 544;

(ggggg) the second modified oligonucleotide comprises a modified nucleobase sequence according to SEQ ID NO: 618 and the first modified oligonucleotide comprises a modified nucleobase sequence according to SEQ ID NO: 545;

(hhhhh) the second modified oligonucleotide comprises a modified nucleobase sequence according to SEQ ID NO: 619 and the first modified oligonucleotide comprises a modified nucleobase sequence according to SEQ ID NO: 546;

(iiiii) the second modified oligonucleotide comprises a modified nucleobase sequence according to SEQ ID NO: 620 and the first modified oligonucleotide comprises a modified nucleobase sequence according to SEQ ID NO: 547;

(jjjjj) the second modified oligonucleotide comprises a modified nucleobase sequence according to SEQ ID NO: 621 and the first modified oligonucleotide comprises a modified nucleobase sequence according to SEQ ID NO: 548;

(kkkkk) the second modified oligonucleotide comprises a modified nucleobase sequence according to SEQ ID NO: 622 and the first modified oligonucleotide comprises a modified nucleobase sequence according to SEQ ID NO: 549;

(lllll) the second modified oligonucleotide comprises a modified nucleobase sequence according to SEQ ID NO: 623 and the first modified oligonucleotide comprises a modified nucleobase sequence according to SEQ ID NO: 550;

(mmmmm) the second modified oligonucleotide comprises a modified nucleobase sequence according to SEQ ID NO: 624 and the first modified oligonucleotide comprises a modified nucleobase sequence according to SEQ ID NO: 551;

(nnnnn) the second modified oligonucleotide comprises a modified nucleobase sequence according to SEQ ID NO: 625 and the first modified oligonucleotide comprises a modified nucleobase sequence according to SEQ ID NO: 552;

(ooooo) the second modified oligonucleotide comprises a modified nucleobase sequence according to SEQ ID NO: 626 and the first modified oligonucleotide comprises a modified nucleobase sequence according to SEQ ID NO: 553;

(ppppp) the second modified oligonucleotide comprises a modified nucleobase sequence according to SEQ ID NO: 627 and the first modified oligonucleotide comprises a modified nucleobase sequence according to SEQ ID NO: 554;

(qqqqq) the second modified oligonucleotide comprises a modified nucleobase sequence according to SEQ ID NO: 628 and the first modified oligonucleotide comprises a modified nucleobase sequence according to SEQ ID NO: 555;

(rrrrr) the second modified oligonucleotide comprises a modified nucleobase sequence according to SEQ ID NO: 629 and the first modified oligonucleotide comprises a modified nucleobase sequence according to SEQ ID NO: 556;

(sssss) the second modified oligonucleotide comprises a modified nucleobase sequence according to SEQ ID NO: 630 and the first modified oligonucleotide comprises a modified nucleobase sequence according to SEQ ID NO: 557;

(ttttt) the second modified oligonucleotide comprises a modified nucleobase sequence according to SEQ ID NO: 631 and the first modified oligonucleotide comprises a modified nucleobase sequence according to SEQ ID NO: 558;

(uuuuu) the second modified oligonucleotide comprises a modified nucleobase sequence according to SEQ ID NO: 632 and the first modified oligonucleotide comprises a modified nucleobase sequence according to SEQ ID NO: 559;

(vvvvv) the second modified oligonucleotide comprises a modified nucleobase sequence according to SEQ ID NO: 633 and the first modified oligonucleotide comprises a modified nucleobase sequence according to SEQ ID NO: 560;

(wwwww) the second modified oligonucleotide comprises a modified nucleobase sequence according to SEQ ID NO: 634 and the first modified oligonucleotide comprises a modified nucleobase sequence according to SEQ ID NO: 561;

(xxxxx) the second modified oligonucleotide comprises a modified nucleobase sequence according to SEQ ID NO: 635 and the first modified oligonucleotide comprises a modified nucleobase sequence according to SEQ ID NO: 562;

(yyyyy) the second modified oligonucleotide comprises a modified nucleobase sequence according to SEQ ID NO: 636 and the first modified oligonucleotide comprises a modified nucleobase sequence according to SEQ ID NO: 563;

(zzzzz) the second modified oligonucleotide comprises a modified nucleobase sequence according to SEQ ID NO: 637 and the first modified oligonucleotide comprises a modified nucleobase sequence according to SEQ ID NO: 564;

(aaaaaa) the second modified oligonucleotide comprises a modified nucleobase sequence according to SEQ ID NO: 638 and the first modified oligonucleotide comprises a modified nucleobase sequence according to SEQ ID NO: 565;

(bbbbbb) the second modified oligonucleotide comprises a modified nucleobase sequence according to SEQ ID NO: 639 and the first modified oligonucleotide comprises a modified nucleobase sequence according to SEQ ID NO: 566;

(cccccc) the second modified oligonucleotide comprises a modified nucleobase sequence according to SEQ ID NO: 640 and the first modified oligonucleotide comprises a modified nucleobase sequence according to SEQ ID NO: 567;

(dddddd) the second modified oligonucleotide comprises a modified nucleobase sequence according to SEQ ID NO: 641 and the first modified oligonucleotide comprises a modified nucleobase sequence according to SEQ ID NO: 568;

(eeeeee) the second modified oligonucleotide comprises a modified nucleobase sequence according to SEQ ID NO: 642 and the first modified oligonucleotide comprises a modified nucleobase sequence according to SEQ ID NO: 569;

(ffffff) the second modified oligonucleotide comprises a modified nucleobase sequence according to SEQ ID NO: 643 and the first modified oligonucleotide comprises a modified nucleobase sequence according to SEQ ID NO: 570;

(gggggg) the second modified oligonucleotide comprises a modified nucleobase sequence according to SEQ ID NO: 644 and the first modified oligonucleotide comprises a modified nucleobase sequence according to SEQ ID NO: 571;

(hhhhhh) the second modified oligonucleotide comprises a modified nucleobase sequence according to SEQ ID NO: 645 and the first modified oligonucleotide comprises a modified nucleobase sequence according to SEQ ID NO: 572;

(iiiiii) the second modified oligonucleotide comprises a modified nucleobase sequence according to SEQ ID NO: 646 and the first modified oligonucleotide comprises a modified nucleobase sequence according to SEQ ID NO: 573;

(jjjjjj) the second modified oligonucleotide comprises a modified nucleobase sequence according to SEQ ID NO: 647 and the first modified oligonucleotide comprises a modified nucleobase sequence according to SEQ ID NO: 574;

(kkkkkk) the second modified oligonucleotide comprises a modified nucleobase sequence according to SEQ ID NO: 648 and the first modified oligonucleotide comprises a modified nucleobase sequence according to SEQ ID NO: 575;

(llllll) the second modified oligonucleotide comprises a modified nucleobase sequence according to SEQ ID NO: 649 and the first modified oligonucleotide comprises a modified nucleobase sequence according to SEQ ID NO: 576;

(mmmmmm) the second modified oligonucleotide comprises a modified nucleobase sequence according to SEQ ID NO: 650 and the first modified oligonucleotide comprises a modified nucleobase sequence according to SEQ ID NO: 577;

(nnnnnn) the second modified oligonucleotide comprises a modified nucleobase sequence according to SEQ ID NO: 651 and the first modified oligonucleotide comprises a modified nucleobase sequence according to SEQ ID NO: 578;

(oooooo) the second modified oligonucleotide comprises a modified nucleobase sequence according to SEQ ID NO: 652 and the first modified oligonucleotide comprises a modified nucleobase sequence according to SEQ ID NO: 579;

(pppppp) the second modified oligonucleotide comprises a modified nucleobase sequence according to SEQ ID NO: 653 and the first modified oligonucleotide comprises a modified nucleobase sequence according to SEQ ID NO: 580;

(qqqqqq) the second modified oligonucleotide comprises a modified nucleobase sequence according to SEQ ID NO: 654 and the first modified oligonucleotide comprises a modified nucleobase sequence according to SEQ ID NO: 581;

(rrrrrr) the second modified oligonucleotide comprises a modified nucleobase sequence according to SEQ ID NO: 655 and the first modified oligonucleotide comprises a modified nucleobase sequence according to SEQ ID NO: 582;

(ssssss) the second modified oligonucleotide comprises a modified nucleobase sequence according to SEQ ID NO: 656 and the first modified oligonucleotide comprises a modified nucleobase sequence according to SEQ ID NO: 583;

(tttttt) the second modified oligonucleotide comprises a modified nucleobase sequence according to SEQ ID NO: 657 and the first modified oligonucleotide comprises a modified nucleobase sequence according to SEQ ID NO: 584;

(uuuuuu) the second modified oligonucleotide comprises a modified nucleobase sequence according to SEQ ID NO: 658 and the first modified oligonucleotide comprises a modified nucleobase sequence according to SEQ ID NO: 585;

(vvvvvv) the second modified oligonucleotide comprises a modified nucleobase sequence according to SEQ ID NO: 659 and the first modified oligonucleotide comprises a modified nucleobase sequence according to SEQ ID NO: 586;

(wwwwww) the second modified oligonucleotide comprises a modified nucleobase sequence according to SEQ ID NO: 660 and the first modified oligonucleotide comprises a modified nucleobase sequence according to SEQ ID NO: 587;

(xxxxxx) the second modified oligonucleotide comprises a modified nucleobase sequence according to SEQ ID NO: 661 and the first modified oligonucleotide comprises a modified nucleobase sequence according to SEQ ID NO: 588;

(yyyyyy) the second modified oligonucleotide comprises a modified nucleobase sequence according to SEQ ID NO: 662 and the first modified oligonucleotide comprises a modified nucleobase sequence according to SEQ ID NO: 589;

(zzzzzz) the second modified oligonucleotide comprises a modified nucleobase sequence according to SEQ ID NO: 663 and the first modified oligonucleotide comprises a modified nucleobase sequence according to SEQ ID NO: 590;

(aaaaaaa) the second modified oligonucleotide comprises a modified nucleobase sequence according to SEQ ID NO: 664 and the first modified oligonucleotide comprises a modified nucleobase sequence according to SEQ ID NO: 591;

(bbbbbbb) the second modified oligonucleotide comprises a modified nucleobase sequence according to SEQ ID NO: 665 and the first modified oligonucleotide comprises a modified nucleobase sequence according to SEQ ID NO: 592;

(ccccccc) the second modified oligonucleotide comprises a modified nucleobase sequence according to SEQ ID NO: 666 and the first modified oligonucleotide comprises a modified nucleobase sequence according to SEQ ID NO: 593;

(ddddddd) the second modified oligonucleotide comprises a modified nucleobase sequence according to SEQ ID NO: 667 and the first modified oligonucleotide comprises a modified nucleobase sequence according to SEQ ID NO: 594;

(eeeeeee) the second modified oligonucleotide comprises a modified nucleobase sequence according to SEQ ID NO: 668 and the first modified oligonucleotide comprises a modified nucleobase sequence according to SEQ ID NO: 595;

(fffffff) the second modified oligonucleotide comprises a modified nucleobase sequence according to SEQ ID NO: 669 and the first modified oligonucleotide comprises a modified nucleobase sequence according to SEQ ID NO: 596;

(ggggggg) the second modified oligonucleotide comprises a modified nucleobase sequence according to SEQ ID NO: 670 and the first modified oligonucleotide comprises a modified nucleobase sequence according to SEQ ID NO: 597;

(hhhhhhh) the second modified oligonucleotide comprises a modified nucleobase sequence according to SEQ ID NO: 671 and the first modified oligonucleotide comprises a modified nucleobase sequence according to SEQ ID NO: 598;

(iiiiiii) the second modified oligonucleotide comprises a modified nucleobase sequence according to SEQ ID NO: 672 and the first modified oligonucleotide comprises a modified nucleobase sequence according to SEQ ID NO: 599;

(jjjjjjj) the second modified oligonucleotide comprises a modified nucleobase sequence according to SEQ ID NO: 673 and the first modified oligonucleotide comprises a modified nucleobase sequence according to SEQ ID NO: 600;

(kkkkkkk) the second modified oligonucleotide comprises a modified nucleobase sequence according to SEQ ID NO: 674 and the first modified oligonucleotide comprises a modified nucleobase sequence according to SEQ ID NO: 601;

(lllllll) the second modified oligonucleotide comprises a modified nucleobase sequence according to SEQ ID NO: 675 and the first modified oligonucleotide comprises a modified nucleobase sequence according to SEQ ID NO: 602;

(mmmmmmm) the second modified oligonucleotide comprises a modified nucleobase sequence according to SEQ ID NO: 676 and the first modified oligonucleotide comprises a modified nucleobase sequence according to SEQ ID NO: 603;

(nnnnnnn) the second modified oligonucleotide comprises a modified nucleobase sequence according to SEQ ID NO: 713 and the first modified oligonucleotide comprises a modified nucleobase sequence according to SEQ ID NO: 701;

(ooooooo) the second modified oligonucleotide comprises a modified nucleobase sequence according to SEQ ID NO: 714 and the first modified oligonucleotide comprises a modified nucleobase sequence according to SEQ ID NO: 702;

(ppppppp) the second modified oligonucleotide comprises a modified nucleobase sequence according to SEQ ID NO: 715 and the first modified oligonucleotide comprises a modified nucleobase sequence according to SEQ ID NO: 703;

(qqqqqqq) the second modified oligonucleotide comprises a modified nucleobase sequence according to SEQ ID NO: 716 and the first modified oligonucleotide comprises a modified nucleobase sequence according to SEQ ID NO: 704;

(rrrrrrr) the second modified oligonucleotide comprises a modified nucleobase sequence according to SEQ ID NO: 717 and the first modified oligonucleotide comprises a modified nucleobase sequence according to SEQ ID NO: 705;

(sssssss) the second modified oligonucleotide comprises a modified nucleobase sequence according to SEQ ID NO: 718 and the first modified oligonucleotide comprises a modified nucleobase sequence according to SEQ ID NO: 706;

(ttttttt) the second modified oligonucleotide comprises a modified nucleobase sequence according to SEQ ID NO: 719 and the first modified oligonucleotide comprises a modified nucleobase sequence according to SEQ ID NO: 707;

(uuuuuuu) the second modified oligonucleotide comprises a modified nucleobase sequence according to SEQ ID NO: 720 and the first modified oligonucleotide comprises a modified nucleobase sequence according to SEQ ID NO: 708;

(vvvvvvv) the second modified oligonucleotide comprises a modified nucleobase sequence according to SEQ ID NO: 721 and the first modified oligonucleotide comprises a modified nucleobase sequence according to SEQ ID NO: 709;

(wwwwwww) the second modified oligonucleotide comprises a modified nucleobase sequence according to SEQ ID NO: 722 and the first modified oligonucleotide comprises a modified nucleobase sequence according to SEQ ID NO: 710;

(xxxxxxx) the second modified oligonucleotide comprises a modified nucleobase sequence according to SEQ ID NO: 723 and the first modified oligonucleotide comprises a modified nucleobase sequence according to SEQ ID NO: 711;

(yyyyyyy) the second modified oligonucleotide comprises a modified nucleobase sequence according to SEQ ID NO: 724 and the antisecond modified oligonucleotide comprises a modified nucleobase sequence according to SEQ ID NO: 712;

(aaaaaaaa) the second modified oligonucleotide comprises a modified nucleobase sequence according to SEQ ID NO: 726 and the first modified oligonucleotide comprises a modified nucleobase sequence according to SEQ ID NO: 603;

(bbbbbbbb) the second modified oligonucleotide comprises a modified nucleobase sequence according to SEQ ID NO: 727 and the first modified oligonucleotide comprises a modified nucleobase sequence according to SEQ ID NO: 596;

(cccccccc) the second modified oligonucleotide comprises a modified nucleobase sequence according to SEQ ID NO: 728 and the first modified oligonucleotide comprises a modified nucleobase sequence according to SEQ ID NO: 703;

(dddddddd) the second modified oligonucleotide comprises a modified nucleobase sequence according to SEQ ID NO: 729 and the first modified oligonucleotide comprises a modified nucleobase sequence according to SEQ ID NO: 701;

(eeeeeeee) the second modified oligonucleotide comprises a modified nucleobase sequence according to SEQ ID NO: 730 and the first modified oligonucleotide comprises a modified nucleobase sequence according to SEQ ID NO: 595; or (ffffffff) the second modified oligonucleotide comprises a modified nucleobase sequence according to SEQ ID NO: 731 and the first modified oligonucleotide comprises a modified nucleobase sequence according to SEQ ID NO: 704.

Embodiment 101. The oligomeric duplex of any one of embodiments 89-100, wherein the first modified oligonucleotide and/or second modified oligonucleotide comprises a targeting ligand.

Embodiment 102. The oligomeric duplex of embodiment 101, wherein the first modified oligonucleotide comprises a targeting ligand conjugated to its 3' end.

Embodiment 103. The modified oligonucleotide of embodiment 101, wherein the first modified oligonucleotide comprises a targeting ligand conjugated to its 5' end.

Embodiment 104. The oligomeric duplex of embodiment 101, wherein the second modified oligonucleotide comprises a targeting ligand conjugated to its 3' end.

Embodiment 105. The oligomeric duplex of embodiment 101, wherein the second modified oligonucleotide comprises a targeting ligand conjugated to its 5' end.

Embodiment 106. The oligomeric duplex of any one of embodiments 101-105, wherein the targeting ligand targets a hepatocyte, and optionally wherein the targeting ligand comprises a galactose trimer.

Embodiment 107. The oligomeric duplex of any one of embodiments 101-106, wherein the targeting ligand comprises N-acetylgalactosamine (GalNac).

Embodiment 108. The oligomeric duplex of any one of embodiments 101-107, wherein the targeting ligand comprises a structure according to Formula I:

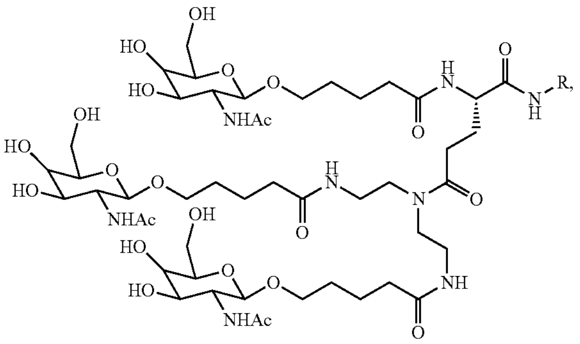

wherein R is:

(i) the first modified oligonucleotide or the second modified oligonucleotide; or (ii) a linker conjugated to the first modified oligonucleotide or the second modified oligonucleotide.

Embodiment 109. The oligomeric duplex of embodiment 108, wherein R is a linker conjugated to the first modified oligonucleotide or the second modified oligonucleotide having a structure according to Formula III:

Formula III

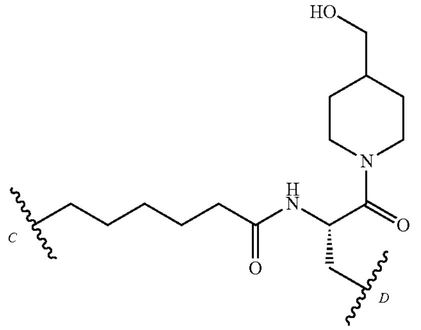

wherein:

(i) connection point C of Formula III is conjugated to Formula I, and connection point D of Formula III is conjugated to the first modified oligonucleotide or the second modified oligonucleotide; or (ii) connection point C of Formula III is conjugated to Formula I, and connection point D of Formula III is conjugated to a phosphate group which is conjugated to the first modified oligonucleotide or the second modified oligonucleotide.

Embodiment 110. The oligomeric duplex of embodiment 109, wherein Formula III or the phosphate group is conjugated to the 3' end or 5' end of the first modified oligonucleotide or the second modified oligonucleotide.

Embodiment 111. The oligomeric duplex of embodiment 109, wherein Formula III or the phosphate group is conjugated to an internal nucleotide or nucleoside base of the first modified oligonucleotide or the second modified oligonucleotide.

Embodiment 112. The oligomeric duplex of any one of embodiments 101-107, wherein the first modified oligonucleotide or the second modified oligonucleotide comprises a targeting ligand and linker according to Formula V:

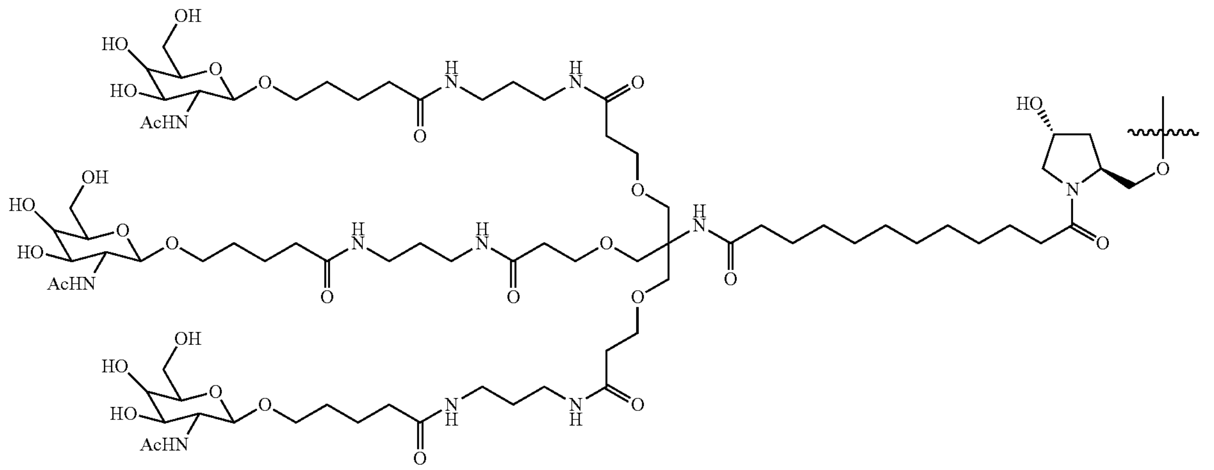 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

Embodiment 113. The oligomeric duplex of any one of embodiments 89-112, wherein the oligomeric duplex is an siRNA molecule.

Embodiment 114. The oligomeric duplex of any one of embodiments 89-112, wherein the oligomeric duplex is an shRNA molecule.

Embodiment 115. A pharmaceutical composition comprising the RNAi agent of any one of embodiments 1-70, the modified oligonucleotide of any one of embodiments 71-88, or the oligomeric duplex of any one of embodiments 89-114, and a pharmaceutically acceptable carrier.

Embodiment 116. A lipid nanoparticle comprising the RNAi agent of any one of embodiments 1-70, the modified oligonucleotide of any one of embodiments 71-88, the oligomeric duplex of any one of embodiments 89-114, or the pharmaceutical composition of embodiment 115.

Embodiment 117. A method of making a pharmaceutical composition, comprising combining the RNAi agent of any one of embodiments 1-70, the modified oligonucleotide of any one of embodiments 71-88, or the oligomeric duplex of any one of embodiments 89-114, with a delivery vehicle selected from the group consisting of a phosphate-buffered saline (PBS), lipid, a nanoparticle, a polymer, a liposome, a micelle, a dynamic polyconjugate (DPC), and antibody-oligo conjugate.

Embodiment 118. A method of treating nonalcoholic fatty liver disease (NAFLD) or nonalcoholic steatohepatitis (NASH) in a subject, comprising:

administering to the subject an effective amount of a liver-targeted modified oligonucleotide, a liver-targeted oligomeric duplex, or a liver-targeted RNAi agent that inhibits expression of insulin receptor substrate-1 (IRS1).

Embodiment 119. Use of a liver-targeted modified oligonucleotide, a liver-targeted oligomeric duplex, or a liver-targeted RNAi agent that inhibits expression of insulin receptor substrate-1 (IRS1) for the manufacture of a medicament for the treatment of nonalcoholic fatty liver disease (NAFLD) or nonalcoholic steatohepatitis (NASH) in a subject.

Embodiment 120. A method of inhibiting expression of insulin receptor substrate-1 (IRS1) in a subject, comprising:

administering to the subject an effective amount of a liver-targeted modified oligonucleotide, a liver-targeted oligomeric duplex, or a liver-targeted RNAi agent that inhibits expression of IRS1.

Embodiment 121. Use of a liver-targeted modified oligonucleotide, a liver-targeted oligomeric duplex, or a liver-targeted RNAi agent in the manufacture of a medicament for inhibiting expression of insulin receptor substrate 1 (IRS1) in a hepatocyte of a subject.

Embodiment 122. A method of controlling or reducing liver fat accumulation in a subject, comprising:

administering to the subject an effective amount of a liver-targeted modified oligonucleotide, a liver-targeted oligomeric duplex, or a liver-targeted RNAi agent that inhibits expression of IRS1.

Embodiment 123. Use of a liver-targeted modified oligonucleotide, a liver-targeted oligomeric duplex, or a liver-targeted RNAi agent that inhibits expression of insulin receptor substrate-1 (IRS1) in the manufacture of a medicament for controlling or reducing liver fat accumulation in a subject.

Embodiment 124. The method or use of embodiment 122 or 123, wherein the method treats metabolic dysfunction-associated steatotic liver disease (MASLD) or metabolic dysfunction-associated steatohepatitis (MASH) in the subject.

Embodiment 125. The method or use of embodiment 122 or 123, wherein the method treats nonalcoholic fatty liver disease (NAFLD) or nonalcoholic steatohepatitis (NASH) in the subject.

Embodiment 126. The method or use of any one of embodiments 118-125, wherein the liver-targeted modified oligonucleotide is the modified oligonucleotide of any one of embodiments 70-87.

Embodiment 127. The method or use of any one of embodiments 118-125, wherein the liver-targeted oligomeric duplex is the oligomeric duplex of any one of embodiments 89-114.

Embodiment 128. The method or use of any one of embodiments 118-125, wherein the RNAi agent comprises an antisense strand and a sense strand that at least partially complements the antisense strand, wherein:

(a) the antisense strand comprises at least 14 contiguous bases from any one of SEQ ID NOS: 1-96, 385-457, and 677-688; and/or (b) the sense strand comprises at least 14 contiguous bases from any one of SEQ ID NOS: 97-192, 458-530, and 689-700.

Embodiment 129. The method or use of embodiment 128, wherein one or more bases of the antisense stand and/or the sense strand are modified.

Embodiment 130. The method or use of embodiment 129, wherein:

(a) the antisense strand comprises at least 14 contiguous bases from any one of SEQ ID NOS: 193-288, 531-603, and 701-712; and/or (b) the sense strand comprises at least 14 contiguous bases from any one of SEQ ID NOS: 289-384, 604-676, 713-724, and 726-731.

Embodiment 131. The method or use of any one of embodiments 118-125, wherein the RNAi agent comprises an antisense strand and a sense strand that at least partially complements the antisense strand, and a targeting ligand conjugated to the antisense strand or the sense strand, wherein the targeting ligand targets a hepatocyte.

Embodiment 132. The method or use of any one of embodiments 128-131, wherein the antisense strand comprises at least 14 contiguous bases that complement a sequence in an mRNA molecule that encodes IRS1 (SEQ ID NO: 725).

Embodiment 133. The method or use of any one of embodiments 128-132, wherein the antisense strand and the sense strand form a duplex of at least 14 bases in length.

Embodiment 134. The method or use of any one of embodiments 128-133, wherein the antisense strand and the sense strand form a duplex of between 15 and 30 bases in length.

Embodiment 135. The method or use of any one of embodiments 128-134, wherein the antisense strand or a subsequence thereof differs by 0, 1, 2, 3, or 4 nucleotides from an equal length portion of any one of SEQ ID NOS: 1-96, 385-457, 677-688, 193-288, 531-603, and 701-712, wherein the subsequence is at least 14, 15, 16, 17, 18, 19, 20, or 21 bases in length.

Embodiment 136. The method or use of embodiment 135, wherein the antisense strand comprises, in order, nucleotides 2-23 of any one of SEQ ID NOS: 1-96, 385-457, 677-688, 193-288, 531-603, and 701-712.

Embodiment 137. The method or use of any one of embodiments 131-136, wherein the antisense strand comprises at least 14 contiguous bases from any one of SEQ ID NOS: 1-96, 385-457, 677-688, 193-288, 531-603, and 701-712.

Embodiment 138. The method or use of any one of embodiments 128-137, wherein the antisense strand comprises, in order, nucleobases 1-14 of any one of SEQ ID NOS: 1-96, 385-457, 677-688, 193-288, 531-603, and 701-712.

Embodiment 139. The method or use of any one of embodiments 128-138, wherein the antisense strand comprises at least 14 contiguous bases from any one of SEQ ID NOS: 449, 450, 457, 595, 596, 603, 677, 679, 680, 701, 703, and 704.

Embodiment 140. The method or use of any one of embodiments 128-139, wherein the sense strand or a subsequence thereof differs by 0, 1, 2, 3, or 4 nucleotides from an equal length portion of any one of SEQ ID NOS: 97-192, 458-530, 689-700, 289-384, 604-676, 713-724, and 726-731, wherein the subsequence is at least 14, 15, 16, 17, 18, 19, 20, or 21 bases in length.

Embodiment 141. The method or use of embodiment 140, wherein the sense strand comprises, in order, nucleotides 1-22 of any one of SEQ ID NOS: 97-192, 458-530, 689-700, 289-384, 604-676, 713-724, and 726-731.

Embodiment 142. The method or use of any one of embodiments 131-141, wherein the sense strand comprises at least 14 contiguous bases from any one of SEQ ID NOS: 97-192, 458-530, 689-700, 289-384, 604-676, 713-724, and 726-731.

Embodiment 143. The method or use of any one of embodiments 128-142, wherein the sense strand comprises, in order, nucleobases 1-14 of any one of SEQ ID NOS: 97-192, 458-530, 689-700, 289-384, 604-676, 713-724, and 726-731.

Embodiment 144. The method or use of any one of embodiments 128-143, wherein the sense strand comprises at least 14 contiguous bases from any one of SEQ ID NOS: 522, 523, 530, 689, 691, 692, 668, 669, 676, 713, 715, 716, and 726-731.

Embodiment 145. The method or use of any one of embodiments 128-144, wherein the antisense strand comprises at least 16 contiguous bases that complement a sequence in an mRNA molecule that encodes IRS1 (SEQ ID NO: 725).

Embodiment 146. The method or use of any one of embodiments 128-145, wherein the antisense strand and the sense strand form a duplex of at least 16 bases in length.

Embodiment 147. The method or use of any one of embodiments 128-146, wherein the antisense strand comprises at least 16 contiguous bases from any one of SEQ ID NOS: 1-96, 385-457, 677-688, 193-288, 531-603, and 701-712.

Embodiment 148. The method or use of embodiment 128-147, wherein the antisense strand comprises at least 16 contiguous bases from any one of SEQ ID NOS: 449, 450, 457, 595, 596, 603, 677, 679, 680, 701, 703, and 704.

Embodiment 149. The method or use of any one of embodiments 128-148, wherein the antisense strand comprises, in order, nucleobases 1-16, 1-17, 1-18, 1-19, 1-20, 1-21, 1-22, 1-23, 2-17, 2-18, 2-19, 2-20, 2-21, 2-22, 2-23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 1-96, 385-457, 677-688, 193-288, 531-603, and 701-712.

Embodiment 150. The method or use of any one of embodiments 128-149, wherein the antisense strand comprises a nucleotide sequence according to any one of SEQ ID NOS: 1-96, 385-457, and 677-688.

Embodiment 151. The method or use of embodiment 150, wherein one or more nucleotides are modified.

Embodiment 152. The method or use of embodiment 150, wherein the antisense strand comprises a nucleotide sequence according to any one of SEQ ID NOS: 449, 450, 457, 677, 679, and 680.

Embodiment 153. The method or use of embodiment 152, wherein one or more nucleotides are modified.

Embodiment 154. The method or use of embodiment 151 or 153, wherein the antisense strand has a modification pattern according to nsNfsnnnNfnnnnnnnNfnNfnnnnnsnsn.

Embodiment 155. The method or use of any one of embodiments 150-153, wherein the antisense strand comprises a modified nucleotide sequence according to any one of SEQ ID NOS: 193-288, 531-603, and 701-712.

Embodiment 156. The method or use of embodiment 155, wherein the antisense strand comprises a modified nucleotide sequence according to any one of SEQ ID NOS: 595, 596, 603, 701, 703, and 704.

Embodiment 157. The method or use of any one of embodiments 128-156, wherein the sense strand comprises at least 16 contiguous bases from any one of SEQ ID NOS: 97-192, 458-530, 689-700, 289-384, 604-676, 713-724, and 726-731.

Embodiment 158. The method or use of embodiment 157, wherein the sense strand comprises at least 16 contiguous bases from any one of SEQ ID NOS: 522, 523, 530, 689, 691, 692, and 726-731.

Embodiment 159. The method or use of any one of embodiments 128-158, wherein the sense strand comprises, in order, nucleobases 1-16, 1-17, 1-18, 1-19, 1-20, 1-21, 1-22, 1-23, 2-17, 2-18, 2-19, 2-20, 2-21, 2-22, 2-23, 3-18, 4-19, 4-20, 4-21, 4-22, 4-23, 5-21, 5-22, 5-23, 6-20, 6-21, 6-22, 6-23, 7-22, 7-23, or 8-23 of any one of SEQ ID NOS: 97-192, 458-530, 689-700, 289-384, 604-676, 713-724, and 726-731.

Embodiment 160. The method or use of any one of embodiments 128-159, wherein the sense strand comprises a nucleobase sequence according to any one of SEQ ID NOS: 97-192, 458-530, and 689-700.

Embodiment 161. The method or use of embodiment 160, wherein one or more nucleotides are modified.

Embodiment 162. The method or use of embodiment 160, wherein the sense strand comprises a nucleobase sequence according to any one of SEQ ID NOS: 522, 523, 530, 689, 691, and 692.

Embodiment 163. The method or use of embodiment 162, wherein one or more nucleotides are modified.

Embodiment 164. The method or use of embodiment 161 or 163, wherein the sense strand has a modification pattern according to nsnsnnnnNfnNfNfNfnnnnnnnnnsnsn.

Embodiment 165. The method or use of embodiment 161 or 163, wherein the sense strand has a modification pattern according to nsnsnnnnNfnNfNfNfnnnnnnnnnn.

Embodiment 166. The method or use of any one of embodiments 160-165, wherein the sense strand comprises a modified nucleotide sequence according to any one of SEQ ID NOS: 289-384, 604-676, 713-724, and 726-731.

Embodiment 167. The method or use of embodiment 166, wherein the sense strand comprises a modified nucleotide sequence according to any one of SEQ ID NOS: 668, 669, 676, 713, 715, 716, and 726-731.

Embodiment 168. The method or use of any one of embodiments 128-167, wherein:

(a) the sense strand comprises a nucleobase sequence according to SEQ ID NO: 97 and the antisense strand comprises a nucleobase sequence according to SEQ ID NO: 1;
(b) the sense strand comprises a nucleobase sequence according to SEQ ID NO: 98 and the antisense strand comprises a nucleobase sequence according to SEQ ID NO: 2;
(c) the sense strand comprises a nucleobase sequence according to SEQ ID NO: 99 and the antisense strand comprises a nucleobase sequence according to SEQ ID NO: 3;
(d) the sense strand comprises a nucleobase sequence according to SEQ ID NO: 100 and the antisense strand comprises a nucleobase sequence according to SEQ ID NO: 4;
(e) the sense strand comprises a nucleobase sequence according to SEQ ID NO: 101 and the antisense strand comprises a nucleobase sequence according to SEQ ID NO: 5;
(f) the sense strand comprises a nucleobase sequence according to SEQ ID NO: 102 and the antisense strand comprises a nucleobase sequence according to SEQ ID NO: 6;
(g) the sense strand comprises a nucleobase sequence according to SEQ ID NO: 103 and the antisense strand comprises a nucleobase sequence according to SEQ ID NO: 7;
(h) the sense strand comprises a nucleobase sequence according to SEQ ID NO: 104 and the antisense strand comprises a nucleobase sequence according to SEQ ID NO: 8;
(i) the sense strand comprises a nucleobase sequence according to SEQ ID NO: 105 and the antisense strand comprises a nucleobase sequence according to SEQ ID NO: 9;
(j) the sense strand comprises a nucleobase sequence according to SEQ ID NO: 106 and the antisense strand comprises a nucleobase sequence according to SEQ ID NO: 10;
(k) the sense strand comprises a nucleobase sequence according to SEQ ID NO: 107 and the antisense strand comprises a nucleobase sequence according to SEQ ID NO: 11;
(l) the sense strand comprises a nucleobase sequence according to SEQ ID NO: 108 and the antisense strand comprises a nucleobase sequence according to SEQ ID NO: 12;
(m) the sense strand comprises a nucleobase sequence according to SEQ ID NO: 109 and the antisense strand comprises a nucleobase sequence according to SEQ ID NO: 13;
(n) the sense strand comprises a nucleobase sequence according to SEQ ID NO: 110 and the antisense strand comprises a nucleobase sequence according to SEQ ID NO: 14;
(o) the sense strand comprises a nucleobase sequence according to SEQ ID NO: 111 and the antisense strand comprises a nucleobase sequence according to SEQ ID NO: 15;
(p) the sense strand comprises a nucleobase sequence according to SEQ ID NO: 112 and the antisense strand comprises a nucleobase sequence according to SEQ ID NO: 16;
(q) the sense strand comprises a nucleobase sequence according to SEQ ID NO: 113 and the antisense strand comprises a nucleobase sequence according to SEQ ID NO: 17;
(r) the sense strand comprises a nucleobase sequence according to SEQ ID NO: 114 and the antisense strand comprises a nucleobase sequence according to SEQ ID NO: 18;
(s) the sense strand comprises a nucleobase sequence according to SEQ ID NO: 115 and the antisense strand comprises a nucleobase sequence according to SEQ ID NO: 19;
(t) the sense strand comprises a nucleobase sequence according to SEQ ID NO: 116 and the antisense strand comprises a nucleobase sequence according to SEQ ID NO: 20;
(u) the sense strand comprises a nucleobase sequence according to SEQ ID NO: 117 and the antisense strand comprises a nucleobase sequence according to SEQ ID NO: 21;
(v) the sense strand comprises a nucleobase sequence according to SEQ ID NO: 118 and the antisense strand comprises a nucleobase sequence according to SEQ ID NO: 22;

(w) the sense strand comprises a nucleobase sequence according to SEQ ID NO: 119 and the antisense strand comprises a nucleobase sequence according to SEQ ID NO: 23;

(x) the sense strand comprises a nucleobase sequence according to SEQ ID NO: 120 and the antisense strand comprises a nucleobase sequence according to SEQ ID NO: 24;

(y) the sense strand comprises a nucleobase sequence according to SEQ ID NO: 121 and the antisense strand comprises a nucleobase sequence according to SEQ ID NO: 25;

(z) the sense strand comprises a nucleobase sequence according to SEQ ID NO: 122 and the antisense strand comprises a nucleobase sequence according to SEQ ID NO: 26;

(aa) the sense strand comprises a nucleobase sequence according to SEQ ID NO: 123 and the antisense strand comprises a nucleobase sequence according to SEQ ID NO: 27;

(bb) the sense strand comprises a nucleobase sequence according to SEQ ID NO: 124 and the antisense strand comprises a nucleobase sequence according to SEQ ID NO: 28;

(cc) the sense strand comprises a nucleobase sequence according to SEQ ID NO: 125 and the antisense strand comprises a nucleobase sequence according to SEQ ID NO: 29;

(dd) the sense strand comprises a nucleobase sequence according to SEQ ID NO: 126 and the antisense strand comprises a nucleobase sequence according to SEQ ID NO: 30;

(ee) the sense strand comprises a nucleobase sequence according to SEQ ID NO: 127 and the antisense strand comprises a nucleobase sequence according to SEQ ID NO: 31;

(ff) the sense strand comprises a nucleobase sequence according to SEQ ID NO: 128 and the antisense strand comprises a nucleobase sequence according to SEQ ID NO: 32;

(gg) the sense strand comprises a nucleobase sequence according to SEQ ID NO: 129 and the antisense strand comprises a nucleobase sequence according to SEQ ID NO: 33;

(hh) the sense strand comprises a nucleobase sequence according to SEQ ID NO: 130 and the antisense strand comprises a nucleobase sequence according to SEQ ID NO: 34;

(ii) the sense strand comprises a nucleobase sequence according to SEQ ID NO: 131 and the antisense strand comprises a nucleobase sequence according to SEQ ID NO: 35;

(jj) the sense strand comprises a nucleobase sequence according to SEQ ID NO: 132 and the antisense strand comprises a nucleobase sequence according to SEQ ID NO: 36;

(kk) the sense strand comprises a nucleobase sequence according to SEQ ID NO: 133 and the antisense strand comprises a nucleobase sequence according to SEQ ID NO: 37;

(ll) the sense strand comprises a nucleobase sequence according to SEQ ID NO: 134 and the antisense strand comprises a nucleobase sequence according to SEQ ID NO: 38;

(mm) the sense strand comprises a nucleobase sequence according to SEQ ID NO: 135 and the antisense strand comprises a nucleobase sequence according to SEQ ID NO: 39;

(nn) the sense strand comprises a nucleobase sequence according to SEQ ID NO: 136 and the antisense strand comprises a nucleobase sequence according to SEQ ID NO: 40;

(oo) the sense strand comprises a nucleobase sequence according to SEQ ID NO: 137 and the antisense strand comprises a nucleobase sequence according to SEQ ID NO: 41;

(pp) the sense strand comprises a nucleobase sequence according to SEQ ID NO: 138 and the antisense strand comprises a nucleobase sequence according to SEQ ID NO: 42;

(qq) the sense strand comprises a nucleobase sequence according to SEQ ID NO: 139 and the antisense strand comprises a nucleobase sequence according to SEQ ID NO: 43;

(rr) the sense strand comprises a nucleobase sequence according to SEQ ID NO: 140 and the antisense strand comprises a nucleobase sequence according to SEQ ID NO: 44;

(ss) the sense strand comprises a nucleobase sequence according to SEQ ID NO: 141 and the antisense strand comprises a nucleobase sequence according to SEQ ID NO: 45;

(tt) the sense strand comprises a nucleobase sequence according to SEQ ID NO: 142 and the antisense strand comprises a nucleobase sequence according to SEQ ID NO: 46;

(uu) the sense strand comprises a nucleobase sequence according to SEQ ID NO: 143 and the antisense strand comprises a nucleobase sequence according to SEQ ID NO: 47;

(vv) the sense strand comprises a nucleobase sequence according to SEQ ID NO: 144 and the antisense strand comprises a nucleobase sequence according to SEQ ID NO: 48;

(ww) the sense strand comprises a nucleobase sequence according to SEQ ID NO: 145 and the antisense strand comprises a nucleobase sequence according to SEQ ID NO: 49;

(xx) the sense strand comprises a nucleobase sequence according to SEQ ID NO: 146 and the antisense strand comprises a nucleobase sequence according to SEQ ID NO: 50;

(yy) the sense strand comprises a nucleobase sequence according to SEQ ID NO: 147 and the antisense strand comprises a nucleobase sequence according to SEQ ID NO: 51;

(zz) the sense strand comprises a nucleobase sequence according to SEQ ID NO: 148 and the antisense strand comprises a nucleobase sequence according to SEQ ID NO: 52;

(aaa) the sense strand comprises a nucleobase sequence according to SEQ ID NO: 149 and the antisense strand comprises a nucleobase sequence according to SEQ ID NO: 53;

(bbb) the sense strand comprises a nucleobase sequence according to SEQ ID NO: 150 and the antisense strand comprises a nucleobase sequence according to SEQ ID NO: 54;

(ccc) the sense strand comprises a nucleobase sequence according to SEQ ID NO: 151 and the antisense strand comprises a nucleobase sequence according to SEQ ID NO: 55;

(ddd) the sense strand comprises a nucleobase sequence according to SEQ ID NO: 152 and the antisense strand comprises a nucleobase sequence according to SEQ ID NO: 56;

(eee) the sense strand comprises a nucleobase sequence according to SEQ ID NO: 153 and the antisense strand comprises a nucleobase sequence according to SEQ ID NO: 57;

(fff) the sense strand comprises a nucleobase sequence according to SEQ ID NO: 154 and the antisense strand comprises a nucleobase sequence according to SEQ ID NO: 58;

(ggg) the sense strand comprises a nucleobase sequence according to SEQ ID NO: 155 and the antisense strand comprises a nucleobase sequence according to SEQ ID NO: 59;

(hhh) the sense strand comprises a nucleobase sequence according to SEQ ID NO: 156 and the antisense strand comprises a nucleobase sequence according to SEQ ID NO: 60;

(iii) the sense strand comprises a nucleobase sequence according to SEQ ID NO: 157 and the antisense strand comprises a nucleobase sequence according to SEQ ID NO: 61;

(jjj) the sense strand comprises a nucleobase sequence according to SEQ ID NO: 158 and the antisense strand comprises a nucleobase sequence according to SEQ ID NO: 62;

(kkk) the sense strand comprises a nucleobase sequence according to SEQ ID NO: 159 and the antisense strand comprises a nucleobase sequence according to SEQ ID NO: 63;

(lll) the sense strand comprises a nucleobase sequence according to SEQ ID NO: 160 and the antisense strand comprises a nucleobase sequence according to SEQ ID NO: 64;

(mmm) the sense strand comprises a nucleobase sequence according to SEQ ID NO: 161 and the antisense strand comprises a nucleobase sequence according to SEQ ID NO: 65;

(nnn) the sense strand comprises a nucleobase sequence according to SEQ ID NO: 162 and the antisense strand comprises a nucleobase sequence according to SEQ ID NO: 66;

(ooo) the sense strand comprises a nucleobase sequence according to SEQ ID NO: 163 and the antisense strand comprises a nucleobase sequence according to SEQ ID NO: 67;

(ppp) the sense strand comprises a nucleobase sequence according to SEQ ID NO: 164 and the antisense strand comprises a nucleobase sequence according to SEQ ID NO: 68;

(qqq) the sense strand comprises a nucleobase sequence according to SEQ ID NO: 165 and the antisense strand comprises a nucleobase sequence according to SEQ ID NO: 69;

(rrr) the sense strand comprises a nucleobase sequence according to SEQ ID NO: 166 and the antisense strand comprises a nucleobase sequence according to SEQ ID NO: 70;

(sss) the sense strand comprises a nucleobase sequence according to SEQ ID NO: 167 and the antisense strand comprises a nucleobase sequence according to SEQ ID NO: 71;

(ttt) the sense strand comprises a nucleobase sequence according to SEQ ID NO: 168 and the antisense strand comprises a nucleobase sequence according to SEQ ID NO: 72;

(uuu) the sense strand comprises a nucleobase sequence according to SEQ ID NO: 169 and the antisense strand comprises a nucleobase sequence according to SEQ ID NO: 73;

(vvv) the sense strand comprises a nucleobase sequence according to SEQ ID NO: 170 and the antisense strand comprises a nucleobase sequence according to SEQ ID NO: 74;

(www) the sense strand comprises a nucleobase sequence according to SEQ ID NO: 171 and the antisense strand comprises a nucleobase sequence according to SEQ ID NO: 75;

(xxx) the sense strand comprises a nucleobase sequence according to SEQ ID NO: 172 and the antisense strand comprises a nucleobase sequence according to SEQ ID NO: 76;

(yyy) the sense strand comprises a nucleobase sequence according to SEQ ID NO: 173 and the antisense strand comprises a nucleobase sequence according to SEQ ID NO: 77;

(zzz) the sense strand comprises a nucleobase sequence according to SEQ ID NO: 174 and the antisense strand comprises a nucleobase sequence according to SEQ ID NO: 78;

(aaaa) the sense strand comprises a nucleobase sequence according to SEQ ID NO: 175 and the antisense strand comprises a nucleobase sequence according to SEQ ID NO: 79;

(bbbb) the sense strand comprises a nucleobase sequence according to SEQ ID NO: 176 and the antisense strand comprises a nucleobase sequence according to SEQ ID NO: 80;

(cccc) the sense strand comprises a nucleobase sequence according to SEQ ID NO: 177 and the antisense strand comprises a nucleobase sequence according to SEQ ID NO: 81;

(dddd) the sense strand comprises a nucleobase sequence according to SEQ ID NO: 178 and the antisense strand comprises a nucleobase sequence according to SEQ ID NO: 82;

(eeee) the sense strand comprises a nucleobase sequence according to SEQ ID NO: 179 and the antisense strand comprises a nucleobase sequence according to SEQ ID NO: 83;

(ffff) the sense strand comprises a nucleobase sequence according to SEQ ID NO: 180 and the antisense strand comprises a nucleobase sequence according to SEQ ID NO: 84;

(gggg) the sense strand comprises a nucleobase sequence according to SEQ ID NO: 181 and the antisense strand comprises a nucleobase sequence according to SEQ ID NO: 85;

(hhhh) the sense strand comprises a nucleobase sequence according to SEQ ID NO: 182 and the antisense strand comprises a nucleobase sequence according to SEQ ID NO: 86;

(iiii) the sense strand comprises a nucleobase sequence according to SEQ ID NO: 183 and the antisense strand comprises a nucleobase sequence according to SEQ ID NO: 87;

(jjjj) the sense strand comprises a nucleobase sequence according to SEQ ID NO: 184 and the antisense strand comprises a nucleobase sequence according to SEQ ID NO: 88;

(kkkk) the sense strand comprises a nucleobase sequence according to SEQ ID NO: 185 and the antisense strand comprises a nucleobase sequence according to SEQ ID NO: 89;

(llll) the sense strand comprises a nucleobase sequence according to SEQ ID NO: 186 and the antisense strand comprises a nucleobase sequence according to SEQ ID NO: 90;

(mmmm) the sense strand comprises a nucleobase sequence according to SEQ ID NO: 187 and the antisense strand comprises a nucleobase sequence according to SEQ ID NO: 91;

(nnnn) the sense strand comprises a nucleobase sequence according to SEQ ID NO: 188 and the antisense strand comprises a nucleobase sequence according to SEQ ID NO: 92;

(oooo) the sense strand comprises a nucleobase sequence according to SEQ ID NO: 189 and the antisense strand comprises a nucleobase sequence according to SEQ ID NO: 93;

(pppp) the sense strand comprises a nucleobase sequence according to SEQ ID NO: 190 and the antisense strand comprises a nucleobase sequence according to SEQ ID NO: 94;

(qqqq) the sense strand comprises a nucleobase sequence according to SEQ ID NO: 191 and the antisense strand comprises a nucleobase sequence according to SEQ ID NO: 95;

(rrrr) the sense strand comprises a nucleobase sequence according to SEQ ID NO: 192 and the antisense strand comprises a nucleobase sequence according to SEQ ID NO: 96;

(ssss) the sense strand comprises a nucleobase sequence according to SEQ ID NO: 458 and the antisense strand comprises a nucleobase sequence according to SEQ ID NO: 385;

(tttt) the sense strand comprises a nucleobase sequence according to SEQ ID NO: 459 and the antisense strand comprises a nucleobase sequence according to SEQ ID NO: 386;

(uuuu) the sense strand comprises a nucleobase sequence according to SEQ ID NO: 460 and the antisense strand comprises a nucleobase sequence according to SEQ ID NO: 387;

(vvvv) the sense strand comprises a nucleobase sequence according to SEQ ID NO: 461 and the antisense strand comprises a nucleobase sequence according to SEQ ID NO: 388;

(wwww) the sense strand comprises a nucleobase sequence according to SEQ ID NO: 462 and the antisense strand comprises a nucleobase sequence according to SEQ ID NO: 389;

(xxxx) the sense strand comprises a nucleobase sequence according to SEQ ID NO: 463 and the antisense strand comprises a nucleobase sequence according to SEQ ID NO: 390;

(yyyy) the sense strand comprises a nucleobase sequence according to SEQ ID NO: 464 and the antisense strand comprises a nucleobase sequence according to SEQ ID NO: 391;

(zzzz) the sense strand comprises a nucleobase sequence according to SEQ ID NO: 465 and the antisense strand comprises a nucleobase sequence according to SEQ ID NO: 392;

(aaaaa) the sense strand comprises a nucleobase sequence according to SEQ ID NO: 466 and the antisense strand comprises a nucleobase sequence according to SEQ ID NO: 393;

(bbbbb) the sense strand comprises a nucleobase sequence according to SEQ ID NO: 467 and the antisense strand comprises a nucleobase sequence according to SEQ ID NO: 394;

(ccccc) the sense strand comprises a nucleobase sequence according to SEQ ID NO: 468 and the antisense strand comprises a nucleobase sequence according to SEQ ID NO: 395;

(ddddd) the sense strand comprises a nucleobase sequence according to SEQ ID NO: 469 and the antisense strand comprises a nucleobase sequence according to SEQ ID NO: 396;

(eeeee) the sense strand comprises a nucleobase sequence according to SEQ ID NO: 470 and the antisense strand comprises a nucleobase sequence according to SEQ ID NO: 397;

(fffff) the sense strand comprises a nucleobase sequence according to SEQ ID NO: 471 and the antisense strand comprises a nucleobase sequence according to SEQ ID NO: 398;

(ggggg) the sense strand comprises a nucleobase sequence according to SEQ ID NO: 472 and the antisense strand comprises a nucleobase sequence according to SEQ ID NO: 399;

(hhhhh) the sense strand comprises a nucleobase sequence according to SEQ ID NO: 473 and the antisense strand comprises a nucleobase sequence according to SEQ ID NO: 400;

(iiiii) the sense strand comprises a nucleobase sequence according to SEQ ID NO: 474 and the antisense strand comprises a nucleobase sequence according to SEQ ID NO: 401;

(jjjjj) the sense strand comprises a nucleobase sequence according to SEQ ID NO: 475 and the antisense strand comprises a nucleobase sequence according to SEQ ID NO: 402;

(kkkkk) the sense strand comprises a nucleobase sequence according to SEQ ID NO: 476 and the antisense strand comprises a nucleobase sequence according to SEQ ID NO: 403;

(lllll) the sense strand comprises a nucleobase sequence according to SEQ ID NO: 477 and the antisense strand comprises a nucleobase sequence according to SEQ ID NO: 404;

(mmmmm) the sense strand comprises a nucleobase sequence according to SEQ ID NO: 478 and the antisense strand comprises a nucleobase sequence according to SEQ ID NO: 405;

(nnnnn) the sense strand comprises a nucleobase sequence according to SEQ ID NO: 479 and the antisense strand comprises a nucleobase sequence according to SEQ ID NO: 406;

(ooooo) the sense strand comprises a nucleobase sequence according to SEQ ID NO: 480 and the antisense strand comprises a nucleobase sequence according to SEQ ID NO: 407;

(ppppp) the sense strand comprises a nucleobase sequence according to SEQ ID NO: 481 and the antisense strand comprises a nucleobase sequence according to SEQ ID NO: 408;

(qqqqq) the sense strand comprises a nucleobase sequence according to SEQ ID NO: 482 and the antisense strand comprises a nucleobase sequence according to SEQ ID NO: 409;

(rrrrr) the sense strand comprises a nucleobase sequence according to SEQ ID NO: 483 and the antisense strand comprises a nucleobase sequence according to SEQ ID NO: 410;

(sssss) the sense strand comprises a nucleobase sequence according to SEQ ID NO: 484 and the antisense strand comprises a nucleobase sequence according to SEQ ID NO: 411;

(ttttt) the sense strand comprises a nucleobase sequence according to SEQ ID NO: 485 and the antisense strand comprises a nucleobase sequence according to SEQ ID NO: 412;

(uuuuu) the sense strand comprises a nucleobase sequence according to SEQ ID NO: 486 and the antisense strand comprises a nucleobase sequence according to SEQ ID NO: 413;

(vvvvv) the sense strand comprises a nucleobase sequence according to SEQ ID NO: 487 and the antisense strand comprises a nucleobase sequence according to SEQ ID NO: 414;

(wwwww) the sense strand comprises a nucleobase sequence according to SEQ ID NO: 488 and the antisense strand comprises a nucleobase sequence according to SEQ ID NO: 415;

(xxxxx) the sense strand comprises a nucleobase sequence according to SEQ ID NO: 489 and the antisense strand comprises a nucleobase sequence according to SEQ ID NO: 416;

(yyyyy) the sense strand comprises a nucleobase sequence according to SEQ ID NO: 490 and the antisense strand comprises a nucleobase sequence according to SEQ ID NO: 417;

(zzzzz) the sense strand comprises a nucleobase sequence according to SEQ ID NO: 491 and the antisense strand comprises a nucleobase sequence according to SEQ ID NO: 418;

(aaaaaa) the sense strand comprises a nucleobase sequence according to SEQ ID NO: 492 and the antisense strand comprises a nucleobase sequence according to SEQ ID NO: 419;

(bbbbbb) the sense strand comprises a nucleobase sequence according to SEQ ID NO: 493 and the antisense strand comprises a nucleobase sequence according to SEQ ID NO: 420;

(cccccc) the sense strand comprises a nucleobase sequence according to SEQ ID NO: 494 and the antisense strand comprises a nucleobase sequence according to SEQ ID NO: 421;

(dddddd) the sense strand comprises a nucleobase sequence according to SEQ ID NO: 495 and the antisense strand comprises a nucleobase sequence according to SEQ ID NO: 422;

(eeeeee) the sense strand comprises a nucleobase sequence according to SEQ ID NO: 496 and the antisense strand comprises a nucleobase sequence according to SEQ ID NO: 423;

(ffffff) the sense strand comprises a nucleobase sequence according to SEQ ID NO: 497 and the antisense strand comprises a nucleobase sequence according to SEQ ID NO: 424;

(gggggg) the sense strand comprises a nucleobase sequence according to SEQ ID NO: 498 and the antisense strand comprises a nucleobase sequence according to SEQ ID NO: 425;

(hhhhhh) the sense strand comprises a nucleobase sequence according to SEQ ID NO: 499 and the antisense strand comprises a nucleobase sequence according to SEQ ID NO: 426;

(iiiiii) the sense strand comprises a nucleobase sequence according to SEQ ID NO: 500 and the antisense strand comprises a nucleobase sequence according to SEQ ID NO: 427;

(jjjjjj) the sense strand comprises a nucleobase sequence according to SEQ ID NO: 501 and the antisense strand comprises a nucleobase sequence according to SEQ ID NO: 428;

(kkkkkk) the sense strand comprises a nucleobase sequence according to SEQ ID NO: 502 and the antisense strand comprises a nucleobase sequence according to SEQ ID NO: 429;

(llllll) the sense strand comprises a nucleobase sequence according to SEQ ID NO: 503 and the antisense strand comprises a nucleobase sequence according to SEQ ID NO: 430;

(mmmmmm) the sense strand comprises a nucleobase sequence according to SEQ ID NO: 504 and the antisense strand comprises a nucleobase sequence according to SEQ ID NO: 431;

(nnnnnn) the sense strand comprises a nucleobase sequence according to SEQ ID NO: 505 and the antisense strand comprises a nucleobase sequence according to SEQ ID NO: 432;

(oooooo) the sense strand comprises a nucleobase sequence according to SEQ ID NO: 506 and the antisense strand comprises a nucleobase sequence according to SEQ ID NO: 433;

(pppppp) the sense strand comprises a nucleobase sequence according to SEQ ID NO: 507 and the antisense strand comprises a nucleobase sequence according to SEQ ID NO: 434;

(qqqqqq) the sense strand comprises a nucleobase sequence according to SEQ ID NO: 508 and the antisense strand comprises a nucleobase sequence according to SEQ ID NO: 435;

(rrrrrr) the sense strand comprises a nucleobase sequence according to SEQ ID NO: 509 and the antisense strand comprises a nucleobase sequence according to SEQ ID NO: 436;

(ssssss) the sense strand comprises a nucleobase sequence according to SEQ ID NO: 510 and the antisense strand comprises a nucleobase sequence according to SEQ ID NO: 437;

(tttttt) the sense strand comprises a nucleobase sequence according to SEQ ID NO: 511 and the antisense strand comprises a nucleobase sequence according to SEQ ID NO: 438;

(uuuuuu) the sense strand comprises a nucleobase sequence according to SEQ ID NO: 512 and the antisense strand comprises a nucleobase sequence according to SEQ ID NO: 439;

(vvvvvv) the sense strand comprises a nucleobase sequence according to SEQ ID NO: 513 and the antisense strand comprises a nucleobase sequence according to SEQ ID NO: 440;

(wwwwww) the sense strand comprises a nucleobase sequence according to SEQ ID NO: 514 and the antisense strand comprises a nucleobase sequence according to SEQ ID NO: 441;

(xxxxxx) the sense strand comprises a nucleobase sequence according to SEQ ID NO: 515 and the antisense strand comprises a nucleobase sequence according to SEQ ID NO: 442;

(yyyyyy) the sense strand comprises a nucleobase sequence according to SEQ ID NO: 516 and the antisense strand comprises a nucleobase sequence according to SEQ ID NO: 443;

(zzzzzz) the sense strand comprises a nucleobase sequence according to SEQ ID NO: 517 and the antisense strand comprises a nucleobase sequence according to SEQ ID NO: 444;

(aaaaaaa) the sense strand comprises a nucleobase sequence according to SEQ ID NO: 518 and the antisense strand comprises a nucleobase sequence according to SEQ ID NO: 445;

(bbbbbbb) the sense strand comprises a nucleobase sequence according to SEQ ID NO: 519 and the antisense strand comprises a nucleobase sequence according to SEQ ID NO: 446;

(ccccccc) the sense strand comprises a nucleobase sequence according to SEQ ID NO: 520 and the antisense strand comprises a nucleobase sequence according to SEQ ID NO: 447;

(ddddddd) the sense strand comprises a nucleobase sequence according to SEQ ID NO: 521 and the antisense strand comprises a nucleobase sequence according to SEQ ID NO: 448;

(eeeeeee) the sense strand comprises a nucleobase sequence according to SEQ ID NO: 522 and the antisense strand comprises a nucleobase sequence according to SEQ ID NO: 449;

(fffffff) the sense strand comprises a nucleobase sequence according to SEQ ID NO: 523 and the antisense strand comprises a nucleobase sequence according to SEQ ID NO: 450;

(ggggggg) the sense strand comprises a nucleobase sequence according to SEQ ID NO: 524 and the antisense strand comprises a nucleobase sequence according to SEQ ID NO: 451;

(hhhhhhh) the sense strand comprises a nucleobase sequence according to SEQ ID NO: 525 and the antisense strand comprises a nucleobase sequence according to SEQ ID NO: 452;

(iiiiiii) the sense strand comprises a nucleobase sequence according to SEQ ID NO: 526 and the antisense strand comprises a nucleobase sequence according to SEQ ID NO: 453;

(jjjjjjj) the sense strand comprises a nucleobase sequence according to SEQ ID NO: 527 and the antisense strand comprises a nucleobase sequence according to SEQ ID NO: 454;

(kkkkkkk) the sense strand comprises a nucleobase sequence according to SEQ ID NO: 528 and the antisense strand comprises a nucleobase sequence according to SEQ ID NO: 455;

(lllllll) the sense strand comprises a nucleobase sequence according to SEQ ID NO: 529 and the antisense strand comprises a nucleobase sequence according to SEQ ID NO: 456;

(mmmmmmm) the sense strand comprises a nucleobase sequence according to SEQ ID NO: 530 and the antisense strand comprises a nucleobase sequence according to SEQ ID NO: 457;

(nnnnnnn) the sense strand comprises a nucleobase sequence according to SEQ ID NO: 689 and the antisense strand comprises a nucleobase sequence according to SEQ ID NO: 677;

(ooooooo) the sense strand comprises a nucleobase sequence according to SEQ ID NO: 690 and the antisense strand comprises a nucleobase sequence according to SEQ ID NO: 678;

(ppppppp) the sense strand comprises a nucleobase sequence according to SEQ ID NO: 691 and the antisense strand comprises a nucleobase sequence according to SEQ ID NO: 679;

(qqqqqqq) the sense strand comprises a nucleobase sequence according to SEQ ID NO: 692 and the antisense strand comprises a nucleobase sequence according to SEQ ID NO: 680;

(rrrrrrr) the sense strand comprises a nucleobase sequence according to SEQ ID NO: 693 and the antisense strand comprises a nucleobase sequence according to SEQ ID NO: 681;

(sssssss) the sense strand comprises a nucleobase sequence according to SEQ ID NO: 694 and the antisense strand comprises a nucleobase sequence according to SEQ ID NO: 682;

(ttttttt) the sense strand comprises a nucleobase sequence according to SEQ ID NO: 695 and the antisense strand comprises a nucleobase sequence according to SEQ ID NO: 683;

(uuuuuuu) the sense strand comprises a nucleobase sequence according to SEQ ID NO: 696 and the antisense strand comprises a nucleobase sequence according to SEQ ID NO: 684;

(vvvvvvv) the sense strand comprises a nucleobase sequence according to SEQ ID NO: 697 and the antisense strand comprises a nucleobase sequence according to SEQ ID NO: 685;

(wwwwwww) the sense strand comprises a nucleobase sequence according to SEQ ID NO: 698 and the antisense strand comprises a nucleobase sequence according to SEQ ID NO: 686;

(xxxxxxx) the sense strand comprises a nucleobase sequence according to SEQ ID NO: 699 and the antisense strand comprises a nucleobase sequence according to SEQ ID NO: 687; or (yyyyyyy) the sense strand comprises a nucleobase sequence according to SEQ ID NO: 700 and the antisense strand comprises a nucleobase sequence according to SEQ ID NO: 688.

Embodiment 169. The method or use of embodiment 168, wherein:

(a) the sense strand comprises a nucleobase sequence according to SEQ ID NO: 530 and the antisense strand comprises a nucleobase sequence according to SEQ ID NO: 457;

(b) the sense strand comprises a nucleobase sequence according to SEQ ID NO: 523 and the antisense strand comprises a nucleobase sequence according to SEQ ID NO: 450;

(c) the sense strand comprises a nucleobase sequence according to SEQ ID NO: 691 and the antisense strand comprises a nucleobase sequence according to SEQ ID NO: 679;

(d) the sense strand comprises a nucleobase sequence according to SEQ ID NO: 689 and the antisense strand comprises a nucleobase sequence according to SEQ ID NO: 677;

(e) the sense strand comprises a nucleobase sequence according to SEQ ID NO: 522 and the antisense strand comprises a nucleobase sequence according to SEQ ID NO: 449; or (f) the sense strand comprises a nucleobase sequence according to SEQ ID NO: 692 and the antisense strand comprises a nucleobase sequence according to SEQ ID NO: 680.

Embodiment 170. The method or use of embodiment 168 or 169, wherein:

(a) the sense strand comprises a modified nucleotide sequence according to SEQ ID NO: 289 and the antisense strand comprises a modified nucleotide sequence according to SEQ ID NO: 193;

(b) the sense strand comprises a modified nucleotide sequence according to SEQ ID NO: 290 and the antisense strand comprises a modified nucleotide sequence according to SEQ ID NO: 194;

(c) the sense strand comprises a modified nucleotide sequence according to SEQ ID NO: 291 and the antisense strand comprises a modified nucleotide sequence according to SEQ ID NO: 195;

(d) the sense strand comprises a modified nucleotide sequence according to SEQ ID NO: 292 and the antisense strand comprises a modified nucleotide sequence according to SEQ ID NO: 196;

(e) the sense strand comprises a modified nucleotide sequence according to SEQ ID NO: 293 and the antisense strand comprises a modified nucleotide sequence according to SEQ ID NO: 197;

(f) the sense strand comprises a modified nucleotide sequence according to SEQ ID NO: 294 and the antisense strand comprises a modified nucleotide sequence according to SEQ ID NO: 198;

(g) the sense strand comprises a modified nucleotide sequence according to SEQ ID NO: 295 and the antisense strand comprises a modified nucleotide sequence according to SEQ ID NO: 199;

(h) the sense strand comprises a modified nucleotide sequence according to SEQ ID NO: 296 and the antisense strand comprises a modified nucleotide sequence according to SEQ ID NO: 200;

(i) the sense strand comprises a modified nucleotide sequence according to SEQ ID NO: 297 and the antisense strand comprises a modified nucleotide sequence according to SEQ ID NO: 201;

(j) the sense strand comprises a modified nucleotide sequence according to SEQ ID NO: 298 and the antisense strand comprises a modified nucleotide sequence according to SEQ ID NO: 202;

(k) the sense strand comprises a modified nucleotide sequence according to SEQ ID NO: 299 and the antisense strand comprises a modified nucleotide sequence according to SEQ ID NO: 203;

(l) the sense strand comprises a modified nucleotide sequence according to SEQ ID NO: 300 and the antisense strand comprises a modified nucleotide sequence according to SEQ ID NO: 204;

(m) the sense strand comprises a modified nucleotide sequence according to SEQ ID NO: 301 and the antisense strand comprises a modified nucleotide sequence according to SEQ ID NO: 205;

(n) the sense strand comprises a modified nucleotide sequence according to SEQ ID NO: 302 and the antisense strand comprises a modified nucleotide sequence according to SEQ ID NO: 206;

(o) the sense strand comprises a modified nucleotide sequence according to SEQ ID NO: 303 and the antisense strand comprises a modified nucleotide sequence according to SEQ ID NO: 207;

(p) the sense strand comprises a modified nucleotide sequence according to SEQ ID NO: 304 and the antisense strand comprises a modified nucleotide sequence according to SEQ ID NO: 208;

(q) the sense strand comprises a modified nucleotide sequence according to SEQ ID NO: 305 and the antisense strand comprises a modified nucleotide sequence according to SEQ ID NO: 209;

(r) the sense strand comprises a modified nucleotide sequence according to SEQ ID NO: 306 and the antisense strand comprises a modified nucleotide sequence according to SEQ ID NO: 210;

(s) the sense strand comprises a modified nucleotide sequence according to SEQ ID NO: 307 and the antisense strand comprises a modified nucleotide sequence according to SEQ ID NO: 211;

(t) the sense strand comprises a modified nucleotide sequence according to SEQ ID NO: 308 and the antisense strand comprises a modified nucleotide sequence according to SEQ ID NO: 212;

(u) the sense strand comprises a modified nucleotide sequence according to SEQ ID NO: 309 and the antisense strand comprises a modified nucleotide sequence according to SEQ ID NO: 213;

(v) the sense strand comprises a modified nucleotide sequence according to SEQ ID NO: 310 and the antisense strand comprises a modified nucleotide sequence according to SEQ ID NO: 214;

(w) the sense strand comprises a modified nucleotide sequence according to SEQ ID NO: 311 and the antisense strand comprises a modified nucleotide sequence according to SEQ ID NO: 215;

(x) the sense strand comprises a modified nucleotide sequence according to SEQ ID NO: 312 and the antisense strand comprises a modified nucleotide sequence according to SEQ ID NO: 216;

(y) the sense strand comprises a modified nucleotide sequence according to SEQ ID NO: 313 and the antisense strand comprises a modified nucleotide sequence according to SEQ ID NO: 217;

(z) the sense strand comprises a modified nucleotide sequence according to SEQ ID NO: 314 and the antisense strand comprises a modified nucleotide sequence according to SEQ ID NO: 218;

(aa) the sense strand comprises a modified nucleotide sequence according to SEQ ID NO: 315 and the antisense strand comprises a modified nucleotide sequence according to SEQ ID NO: 219;

(bb) the sense strand comprises a modified nucleotide sequence according to SEQ ID NO: 316 and the antisense strand comprises a modified nucleotide sequence according to SEQ ID NO: 220;

(cc) the sense strand comprises a modified nucleotide sequence according to SEQ ID NO: 317 and the antisense strand comprises a modified nucleotide sequence according to SEQ ID NO: 221;

(dd) the sense strand comprises a modified nucleotide sequence according to SEQ ID NO: 318 and the antisense strand comprises a modified nucleotide sequence according to SEQ ID NO: 222;

(ee) the sense strand comprises a modified nucleotide sequence according to SEQ ID NO: 319 and the antisense strand comprises a modified nucleotide sequence according to SEQ ID NO: 223;

(ff) the sense strand comprises a modified nucleotide sequence according to SEQ ID NO: 320 and the antisense strand comprises a modified nucleotide sequence according to SEQ ID NO: 224;

(gg) the sense strand comprises a modified nucleotide sequence according to SEQ ID NO: 321 and the antisense strand comprises a modified nucleotide sequence according to SEQ ID NO: 225;

(hh) the sense strand comprises a modified nucleotide sequence according to SEQ ID NO: 322 and the antisense strand comprises a modified nucleotide sequence according to SEQ ID NO: 226;

(ii) the sense strand comprises a modified nucleotide sequence according to SEQ ID NO: 323 and the antisense strand comprises a modified nucleotide sequence according to SEQ ID NO: 227;

(jj) the sense strand comprises a modified nucleotide sequence according to SEQ ID NO: 324 and the antisense strand comprises a modified nucleotide sequence according to SEQ ID NO: 228;

(kk) the sense strand comprises a modified nucleotide sequence according to SEQ ID NO: 325 and the antisense strand comprises a modified nucleotide sequence according to SEQ ID NO: 229;

(ll) the sense strand comprises a modified nucleotide sequence according to SEQ ID NO: 326 and the antisense strand comprises a modified nucleotide sequence according to SEQ ID NO: 230;

(mm) the sense strand comprises a modified nucleotide sequence according to SEQ ID NO: 327 and the antisense strand comprises a modified nucleotide sequence according to SEQ ID NO: 231;

(nn) the sense strand comprises a modified nucleotide sequence according to SEQ ID NO: 328 and the antisense strand comprises a modified nucleotide sequence according to SEQ ID NO: 232;

(oo) the sense strand comprises a modified nucleotide sequence according to SEQ ID NO: 329 and the antisense strand comprises a modified nucleotide sequence according to SEQ ID NO: 233;

(pp) the sense strand comprises a modified nucleotide sequence according to SEQ ID NO: 330 and the antisense strand comprises a modified nucleotide sequence according to SEQ ID NO: 234;

(qq) the sense strand comprises a modified nucleotide sequence according to SEQ ID NO: 331 and the antisense strand comprises a modified nucleotide sequence according to SEQ ID NO: 235;

(rr) the sense strand comprises a modified nucleotide sequence according to SEQ ID NO: 332 and the antisense strand comprises a modified nucleotide sequence according to SEQ ID NO: 236;

(ss) the sense strand comprises a modified nucleotide sequence according to SEQ ID NO: 333 and the antisense strand comprises a modified nucleotide sequence according to SEQ ID NO: 237;

(tt) the sense strand comprises a modified nucleotide sequence according to SEQ ID NO: 334 and the antisense strand comprises a modified nucleotide sequence according to SEQ ID NO: 238;

(uu) the sense strand comprises a modified nucleotide sequence according to SEQ ID NO: 335 and the antisense strand comprises a modified nucleotide sequence according to SEQ ID NO: 239;

(vv) the sense strand comprises a modified nucleotide sequence according to SEQ ID NO: 336 and the antisense strand comprises a modified nucleotide sequence according to SEQ ID NO: 240;

(ww) the sense strand comprises a modified nucleotide sequence according to SEQ ID NO: 337 and the antisense strand comprises a modified nucleotide sequence according to SEQ ID NO: 241;

(xx) the sense strand comprises a modified nucleotide sequence according to SEQ ID NO: 338 and the antisense strand comprises a modified nucleotide sequence according to SEQ ID NO: 242;

(yy) the sense strand comprises a modified nucleotide sequence according to SEQ ID NO: 339 and the antisense strand comprises a modified nucleotide sequence according to SEQ ID NO: 243;

(zz) the sense strand comprises a modified nucleotide sequence according to SEQ ID NO: 340 and the antisense strand comprises a modified nucleotide sequence according to SEQ ID NO: 244;

(aaa) the sense strand comprises a modified nucleotide sequence according to SEQ ID NO: 341 and the antisense strand comprises a modified nucleotide sequence according to SEQ ID NO: 245;

(bbb) the sense strand comprises a modified nucleotide sequence according to SEQ ID NO: 342 and the antisense strand comprises a modified nucleotide sequence according to SEQ ID NO: 246;

(ccc) the sense strand comprises a modified nucleotide sequence according to SEQ ID NO: 343 and the antisense strand comprises a modified nucleotide sequence according to SEQ ID NO: 247;

(ddd) the sense strand comprises a modified nucleotide sequence according to SEQ ID NO: 344 and the antisense strand comprises a modified nucleotide sequence according to SEQ ID NO: 248;

(eee) the sense strand comprises a modified nucleotide sequence according to SEQ ID NO: 345 and the antisense strand comprises a modified nucleotide sequence according to SEQ ID NO: 249;

(fff) the sense strand comprises a modified nucleotide sequence according to SEQ ID NO: 346 and the antisense strand comprises a modified nucleotide sequence according to SEQ ID NO: 250;

(ggg) the sense strand comprises a modified nucleotide sequence according to SEQ ID NO: 347 and the antisense strand comprises a modified nucleotide sequence according to SEQ ID NO: 251;

(hhh) the sense strand comprises a modified nucleotide sequence according to SEQ ID NO: 348 and the antisense strand comprises a modified nucleotide sequence according to SEQ ID NO: 252;

(iii) the sense strand comprises a modified nucleotide sequence according to SEQ ID NO: 349 and the antisense strand comprises a modified nucleotide sequence according to SEQ ID NO: 253;

(jj) the sense strand comprises a modified nucleotide sequence according to SEQ ID NO: 350 and the antisense strand comprises a modified nucleotide sequence according to SEQ ID NO: 254;

(kkk) the sense strand comprises a modified nucleotide sequence according to SEQ ID NO: 351 and the antisense strand comprises a modified nucleotide sequence according to SEQ ID NO: 255;

(lll) the sense strand comprises a modified nucleotide sequence according to SEQ ID NO: 352 and the antisense strand comprises a modified nucleotide sequence according to SEQ ID NO: 256;

(mmm) the sense strand comprises a modified nucleotide sequence according to SEQ ID NO: 353 and the antisense strand comprises a modified nucleotide sequence according to SEQ ID NO: 257;

(nnn) the sense strand comprises a modified nucleotide sequence according to SEQ ID NO: 354 and the antisense strand comprises a modified nucleotide sequence according to SEQ ID NO: 258;

(ooo) the sense strand comprises a modified nucleotide sequence according to SEQ ID NO: 355 and the antisense strand comprises a modified nucleotide sequence according to SEQ ID NO: 259;

(ppp) the sense strand comprises a modified nucleotide sequence according to SEQ ID NO: 356 and the antisense strand comprises a modified nucleotide sequence according to SEQ ID NO: 260;

(qqq) the sense strand comprises a modified nucleotide sequence according to SEQ ID NO: 357 and the antisense strand comprises a modified nucleotide sequence according to SEQ ID NO: 261;

(rrr) the sense strand comprises a modified nucleotide sequence according to SEQ ID NO: 358 and the antisense strand comprises a modified nucleotide sequence according to SEQ ID NO: 262;

(sss) the sense strand comprises a modified nucleotide sequence according to SEQ ID NO: 359 and the antisense strand comprises a modified nucleotide sequence according to SEQ ID NO: 263;

(ttt) the sense strand comprises a modified nucleotide sequence according to SEQ ID NO: 360 and the antisense strand comprises a modified nucleotide sequence according to SEQ ID NO: 264;

(uuu) the sense strand comprises a modified nucleotide sequence according to SEQ ID NO: 361 and the antisense strand comprises a modified nucleotide sequence according to SEQ ID NO: 265;

(vvv) the sense strand comprises a modified nucleotide sequence according to SEQ ID NO: 362 and the antisense strand comprises a modified nucleotide sequence according to SEQ ID NO: 266;

(www) the sense strand comprises a modified nucleotide sequence according to SEQ ID NO: 363 and the antisense strand comprises a modified nucleotide sequence according to SEQ ID NO: 267;

(xxx) the sense strand comprises a modified nucleotide sequence according to SEQ ID NO: 364 and the antisense strand comprises a modified nucleotide sequence according to SEQ ID NO: 268;

(yyy) the sense strand comprises a modified nucleotide sequence according to SEQ ID NO: 365 and the antisense strand comprises a modified nucleotide sequence according to SEQ ID NO: 269;

(zzz) the sense strand comprises a modified nucleotide sequence according to SEQ ID NO: 366 and the antisense strand comprises a modified nucleotide sequence according to SEQ ID NO: 270;

(aaaa) the sense strand comprises a modified nucleotide sequence according to SEQ ID NO: 367 and the antisense strand comprises a modified nucleotide sequence according to SEQ ID NO: 271;

(bbbb) the sense strand comprises a modified nucleotide sequence according to SEQ ID NO: 368 and the antisense strand comprises a modified nucleotide sequence according to SEQ ID NO: 272;

(cccc) the sense strand comprises a modified nucleotide sequence according to SEQ ID NO: 369 and the antisense strand comprises a modified nucleotide sequence according to SEQ ID NO: 273;

(dddd) the sense strand comprises a modified nucleotide sequence according to SEQ ID NO: 370 and the antisense strand comprises a modified nucleotide sequence according to SEQ ID NO: 274;

(eeee) the sense strand comprises a modified nucleotide sequence according to SEQ ID NO: 371 and the antisense strand comprises a modified nucleotide sequence according to SEQ ID NO: 275;

(ffff) the sense strand comprises a modified nucleotide sequence according to SEQ ID NO: 372 and the antisense strand comprises a modified nucleotide sequence according to SEQ ID NO: 276;

(gggg) the sense strand comprises a modified nucleotide sequence according to SEQ ID NO: 373 and the antisense strand comprises a modified nucleotide sequence according to SEQ ID NO: 277;

(hhhh) the sense strand comprises a modified nucleotide sequence according to SEQ ID NO: 374 and the antisense strand comprises a modified nucleotide sequence according to SEQ ID NO: 278;

(iiii) the sense strand comprises a modified nucleotide sequence according to SEQ ID NO: 375 and the antisense strand comprises a modified nucleotide sequence according to SEQ ID NO: 279;

(jjjj) the sense strand comprises a modified nucleotide sequence according to SEQ ID NO: 376 and the antisense strand comprises a modified nucleotide sequence according to SEQ ID NO: 280;

(kkkk) the sense strand comprises a modified nucleotide sequence according to SEQ ID NO: 377 and the antisense strand comprises a modified nucleotide sequence according to SEQ ID NO: 281;

(llll) the sense strand comprises a modified nucleotide sequence according to SEQ ID NO: 378 and the antisense strand comprises a modified nucleotide sequence according to SEQ ID NO: 282;

(mmmm) the sense strand comprises a modified nucleotide sequence according to SEQ ID NO: 379 and the antisense strand comprises a modified nucleotide sequence according to SEQ ID NO: 283;

(nnnn) the sense strand comprises a modified nucleotide sequence according to SEQ ID NO: 380 and the antisense strand comprises a modified nucleotide sequence according to SEQ ID NO: 284;

(oooo) the sense strand comprises a modified nucleotide sequence according to SEQ ID NO: 381 and the antisense strand comprises a modified nucleotide sequence according to SEQ ID NO: 285;

(pppp) the sense strand comprises a modified nucleotide sequence according to SEQ ID NO: 382 and the antisense strand comprises a modified nucleotide sequence according to SEQ ID NO: 286;

(qqqq) the sense strand comprises a modified nucleotide sequence according to SEQ ID NO: 383 and the antisense strand comprises a modified nucleotide sequence according to SEQ ID NO: 287;

(rrrr) the sense strand comprises a modified nucleotide sequence according to SEQ ID NO: 384 and the antisense strand comprises a modified nucleotide sequence according to SEQ ID NO: 288;

(ssss) the sense strand comprises a modified nucleobase sequence according to SEQ ID NO: 604 and the antisense strand comprises a modified nucleobase sequence according to SEQ ID NO: 531;

(tttt) the sense strand comprises a modified nucleobase sequence according to SEQ ID NO: 605 and the antisense strand comprises a modified nucleobase sequence according to SEQ ID NO: 532;

(uuuu) the sense strand comprises a modified nucleobase sequence according to SEQ ID NO: 606 and the antisense strand comprises a modified nucleobase sequence according to SEQ ID NO: 533;

(vvvv) the sense strand comprises a modified nucleobase sequence according to SEQ ID NO: 607 and the antisense strand comprises a modified nucleobase sequence according to SEQ ID NO: 534;

(wwww) the sense strand comprises a modified nucleobase sequence according to SEQ ID NO: 608 and the antisense strand comprises a modified nucleobase sequence according to SEQ ID NO: 535;

(xxxx) the sense strand comprises a modified nucleobase sequence according to SEQ ID NO: 609 and the antisense strand comprises a modified nucleobase sequence according to SEQ ID NO: 536;

(yyyy) the sense strand comprises a modified nucleobase sequence according to SEQ ID NO: 610 and the antisense strand comprises a modified nucleobase sequence according to SEQ ID NO: 537;

(zzzz) the sense strand comprises a modified nucleobase sequence according to SEQ ID NO: 611 and the antisense strand comprises a modified nucleobase sequence according to SEQ ID NO: 538;

(aaaaa) the sense strand comprises a modified nucleobase sequence according to SEQ ID NO: 612 and the antisense strand comprises a modified nucleobase sequence according to SEQ ID NO: 539;

(bbbbb) the sense strand comprises a modified nucleobase sequence according to SEQ ID NO: 613 and the antisense strand comprises a modified nucleobase sequence according to SEQ ID NO: 540;

(ccccc) the sense strand comprises a modified nucleobase sequence according to SEQ ID NO: 614 and the antisense strand comprises a modified nucleobase sequence according to SEQ ID NO: 541;

(ddddd) the sense strand comprises a modified nucleobase sequence according to SEQ ID NO: 615 and the antisense strand comprises a modified nucleobase sequence according to SEQ ID NO: 542;

(eeeee) the sense strand comprises a modified nucleobase sequence according to SEQ ID NO: 616 and the antisense strand comprises a modified nucleobase sequence according to SEQ ID NO: 543;

(fffff) the sense strand comprises a modified nucleobase sequence according to SEQ ID NO: 617 and the antisense strand comprises a modified nucleobase sequence according to SEQ ID NO: 544;

(ggggg) the sense strand comprises a modified nucleobase sequence according to SEQ ID NO: 618 and the antisense strand comprises a modified nucleobase sequence according to SEQ ID NO: 545;

(hhhhh) the sense strand comprises a modified nucleobase sequence according to SEQ ID NO: 619 and the antisense strand comprises a modified nucleobase sequence according to SEQ ID NO: 546;

(iiiii) the sense strand comprises a modified nucleobase sequence according to SEQ ID NO: 620 and the antisense strand comprises a modified nucleobase sequence according to SEQ ID NO: 547;

(jjjjj) the sense strand comprises a modified nucleobase sequence according to SEQ ID NO: 621 and the antisense strand comprises a modified nucleobase sequence according to SEQ ID NO: 548;

(kkkkk) the sense strand comprises a modified nucleobase sequence according to SEQ ID NO: 622 and the antisense strand comprises a modified nucleobase sequence according to SEQ ID NO: 549;

(lllll) the sense strand comprises a modified nucleobase sequence according to SEQ ID NO: 623 and the antisense strand comprises a modified nucleobase sequence according to SEQ ID NO: 550;

(mmmmm) the sense strand comprises a modified nucleobase sequence according to SEQ ID NO: 624 and the antisense strand comprises a modified nucleobase sequence according to SEQ ID NO: 551;

(nnnnn) the sense strand comprises a modified nucleobase sequence according to SEQ ID NO: 625 and the antisense strand comprises a modified nucleobase sequence according to SEQ ID NO: 552;

(ooooo) the sense strand comprises a modified nucleobase sequence according to SEQ ID NO: 626 and the antisense strand comprises a modified nucleobase sequence according to SEQ ID NO: 553;

(ppppp) the sense strand comprises a modified nucleobase sequence according to SEQ ID NO: 627 and the antisense strand comprises a modified nucleobase sequence according to SEQ ID NO: 554;

(qqqqq) the sense strand comprises a modified nucleobase sequence according to SEQ ID NO: 628 and the antisense strand comprises a modified nucleobase sequence according to SEQ ID NO: 555;

(rrrrr) the sense strand comprises a modified nucleobase sequence according to SEQ ID NO: 629 and the antisense strand comprises a modified nucleobase sequence according to SEQ ID NO: 556;

(sssss) the sense strand comprises a modified nucleobase sequence according to SEQ ID NO: 630 and the antisense strand comprises a modified nucleobase sequence according to SEQ ID NO: 557;

(ttttt) the sense strand comprises a modified nucleobase sequence according to SEQ ID NO: 631 and the antisense strand comprises a modified nucleobase sequence according to SEQ ID NO: 558;

(uuuuu) the sense strand comprises a modified nucleobase sequence according to SEQ ID NO: 632 and the antisense strand comprises a modified nucleobase sequence according to SEQ ID NO: 559;

(vvvvv) the sense strand comprises a modified nucleobase sequence according to SEQ ID NO: 633 and the antisense strand comprises a modified nucleobase sequence according to SEQ ID NO: 560;

(wwwww) the sense strand comprises a modified nucleobase sequence according to SEQ ID NO: 634 and the antisense strand comprises a modified nucleobase sequence according to SEQ ID NO: 561;

(xxxxx) the sense strand comprises a modified nucleobase sequence according to SEQ ID NO: 635 and the antisense strand comprises a modified nucleobase sequence according to SEQ ID NO: 562;

(yyyyy) the sense strand comprises a modified nucleobase sequence according to SEQ ID NO: 636 and the antisense strand comprises a modified nucleobase sequence according to SEQ ID NO: 563;

(zzzzz) the sense strand comprises a modified nucleobase sequence according to SEQ ID NO: 637 and the antisense strand comprises a modified nucleobase sequence according to SEQ ID NO: 564;

(aaaaaa) the sense strand comprises a modified nucleobase sequence according to SEQ ID NO: 638 and the antisense strand comprises a modified nucleobase sequence according to SEQ ID NO: 565;

(bbbbbb) the sense strand comprises a modified nucleobase sequence according to SEQ ID NO: 639 and the antisense strand comprises a modified nucleobase sequence according to SEQ ID NO: 566;

(cccccc) the sense strand comprises a modified nucleobase sequence according to SEQ ID NO: 640 and the antisense strand comprises a modified nucleobase sequence according to SEQ ID NO: 567;

(dddddd) the sense strand comprises a modified nucleobase sequence according to SEQ ID NO: 641 and the antisense strand comprises a modified nucleobase sequence according to SEQ ID NO: 568;

(eeeeee) the sense strand comprises a modified nucleobase sequence according to SEQ ID NO: 642 and the antisense strand comprises a modified nucleobase sequence according to SEQ ID NO: 569;

(ffffff) the sense strand comprises a modified nucleobase sequence according to SEQ ID NO: 643 and the antisense strand comprises a modified nucleobase sequence according to SEQ ID NO: 570;

(gggggg) the sense strand comprises a modified nucleobase sequence according to SEQ ID NO: 644 and the antisense strand comprises a modified nucleobase sequence according to SEQ ID NO: 571;

(hhhhhh) the sense strand comprises a modified nucleobase sequence according to SEQ ID NO: 645 and the antisense strand comprises a modified nucleobase sequence according to SEQ ID NO: 572;

(iiiiii) the sense strand comprises a modified nucleobase sequence according to SEQ ID NO: 646 and the antisense strand comprises a modified nucleobase sequence according to SEQ ID NO: 573;

(jjjjjj) the sense strand comprises a modified nucleobase sequence according to SEQ ID NO: 647 and the antisense strand comprises a modified nucleobase sequence according to SEQ ID NO: 574;

(kkkkkk) the sense strand comprises a modified nucleobase sequence according to SEQ ID NO: 648 and the antisense strand comprises a modified nucleobase sequence according to SEQ ID NO: 575;

(llllll) the sense strand comprises a modified nucleobase sequence according to SEQ ID NO: 649 and the antisense strand comprises a modified nucleobase sequence according to SEQ ID NO: 576;

(mmmmmm) the sense strand comprises a modified nucleobase sequence according to SEQ ID NO: 650 and the antisense strand comprises a modified nucleobase sequence according to SEQ ID NO: 577;

(nnnnnn) the sense strand comprises a modified nucleobase sequence according to SEQ ID NO: 651 and the antisense strand comprises a modified nucleobase sequence according to SEQ ID NO: 578;

(oooooo) the sense strand comprises a modified nucleobase sequence according to SEQ ID NO: 652 and the antisense strand comprises a modified nucleobase sequence according to SEQ ID NO: 579;

(pppppp) the sense strand comprises a modified nucleobase sequence according to SEQ ID NO: 653 and the antisense strand comprises a modified nucleobase sequence according to SEQ ID NO: 580;

(qqqqqq) the sense strand comprises a modified nucleobase sequence according to SEQ ID NO: 654 and the antisense strand comprises a modified nucleobase sequence according to SEQ ID NO: 581;

(rrrrrr) the sense strand comprises a modified nucleobase sequence according to SEQ ID NO: 655 and the antisense strand comprises a modified nucleobase sequence according to SEQ ID NO: 582;

(ssssss) the sense strand comprises a modified nucleobase sequence according to SEQ ID NO: 656 and the antisense strand comprises a modified nucleobase sequence according to SEQ ID NO: 583;

(tttttt) the sense strand comprises a modified nucleobase sequence according to SEQ ID NO: 657 and the antisense strand comprises a modified nucleobase sequence according to SEQ ID NO: 584;

(uuuuuu) the sense strand comprises a modified nucleobase sequence according to SEQ ID NO: 658 and the antisense strand comprises a modified nucleobase sequence according to SEQ ID NO: 585;

(vvvvvv) the sense strand comprises a modified nucleobase sequence according to SEQ ID NO: 659 and the antisense strand comprises a modified nucleobase sequence according to SEQ ID NO: 586;

(wwwwww) the sense strand comprises a modified nucleobase sequence according to SEQ ID NO: 660 and the antisense strand comprises a modified nucleobase sequence according to SEQ ID NO: 587;

(xxxxxx) the sense strand comprises a modified nucleobase sequence according to SEQ ID NO: 661 and the antisense strand comprises a modified nucleobase sequence according to SEQ ID NO: 588;

(yyyyyy) the sense strand comprises a modified nucleobase sequence according to SEQ ID NO: 662 and the antisense strand comprises a modified nucleobase sequence according to SEQ ID NO: 589;

(zzzzzz) the sense strand comprises a modified nucleobase sequence according to SEQ ID NO: 663 and the antisense strand comprises a modified nucleobase sequence according to SEQ ID NO: 590;

(aaaaaaa) the sense strand comprises a modified nucleobase sequence according to SEQ ID NO: 664 and the antisense strand comprises a modified nucleobase sequence according to SEQ ID NO: 591;

(bbbbbbb) the sense strand comprises a modified nucleobase sequence according to SEQ ID NO: 665 and the antisense strand comprises a modified nucleobase sequence according to SEQ ID NO: 592;

(ccccccc) the sense strand comprises a modified nucleobase sequence according to SEQ ID NO: 666 and the antisense strand comprises a modified nucleobase sequence according to SEQ ID NO: 593;

(ddddddd) the sense strand comprises a modified nucleobase sequence according to SEQ ID NO: 667 and the antisense strand comprises a modified nucleobase sequence according to SEQ ID NO: 594;

(eeeeeee) the sense strand comprises a modified nucleobase sequence according to SEQ ID NO: 668 and the antisense strand comprises a modified nucleobase sequence according to SEQ ID NO: 595;

(fffffff) the sense strand comprises a modified nucleobase sequence according to SEQ ID NO: 669 and the antisense strand comprises a modified nucleobase sequence according to SEQ ID NO: 596;

(ggggggg) the sense strand comprises a modified nucleobase sequence according to SEQ ID NO: 670 and the antisense strand comprises a modified nucleobase sequence according to SEQ ID NO: 597;

(hhhhhhh) the sense strand comprises a modified nucleobase sequence according to SEQ ID NO: 671 and the antisense strand comprises a modified nucleobase sequence according to SEQ ID NO: 598;

(iiiiiii) the sense strand comprises a modified nucleobase sequence according to SEQ ID NO: 672 and the antisense strand comprises a modified nucleobase sequence according to SEQ ID NO: 599;

(jjjjjjj) the sense strand comprises a modified nucleobase sequence according to SEQ ID NO: 673 and the antisense strand comprises a modified nucleobase sequence according to SEQ ID NO: 600;

(kkkkkkk) the sense strand comprises a modified nucleobase sequence according to SEQ ID NO: 674 and the antisense strand comprises a modified nucleobase sequence according to SEQ ID NO: 601;

(lllllll) the sense strand comprises a modified nucleobase sequence according to SEQ ID NO: 675 and the antisense strand comprises a modified nucleobase sequence according to SEQ ID NO: 602;

(mmmmmmm) the sense strand comprises a modified nucleobase sequence according to SEQ ID NO: 676 and the antisense strand comprises a modified nucleobase sequence according to SEQ ID NO: 603;

(nnnnnnn) the sense strand comprises a modified nucleobase sequence according to SEQ ID NO: 713 and the antisense strand comprises a modified nucleobase sequence according to SEQ ID NO: 701;

(ooooooo) the sense strand comprises a modified nucleobase sequence according to SEQ ID NO: 714 and the antisense strand comprises a modified nucleobase sequence according to SEQ ID NO: 702;

(ppppppp) the sense strand comprises a modified nucleobase sequence according to SEQ ID NO: 715 and the antisense strand comprises a modified nucleobase sequence according to SEQ ID NO: 703;

(qqqqqqq) the sense strand comprises a modified nucleobase sequence according to SEQ ID NO: 716 and the antisense strand comprises a modified nucleobase sequence according to SEQ ID NO: 704;

(rrrrrrr) the sense strand comprises a modified nucleobase sequence according to SEQ ID NO: 717 and the antisense strand comprises a modified nucleobase sequence according to SEQ ID NO: 705;

(sssssss) the sense strand comprises a modified nucleobase sequence according to SEQ ID NO: 718 and the antisense strand comprises a modified nucleobase sequence according to SEQ ID NO: 706;

(ttttttt) the sense strand comprises a modified nucleobase sequence according to SEQ ID NO: 719 and the antisense strand comprises a modified nucleobase sequence according to SEQ ID NO: 707;

(uuuuuuu) the sense strand comprises a modified nucleobase sequence according to SEQ ID NO: 720 and the antisense strand comprises a modified nucleobase sequence according to SEQ ID NO: 708;

(vvvvvvv) the sense strand comprises a modified nucleobase sequence according to SEQ ID NO: 721 and the antisense strand comprises a modified nucleobase sequence according to SEQ ID NO: 709;

(wwwwwww) the sense strand comprises a modified nucleobase sequence according to SEQ ID NO: 722 and the antisense strand comprises a modified nucleobase sequence according to SEQ ID NO: 710;

(xxxxxxx) the sense strand comprises a modified nucleobase sequence according to SEQ ID NO: 723 and the antisense strand comprises a modified nucleobase sequence according to SEQ ID NO: 711;

(yyyyyyy) the sense strand comprises a modified nucleobase sequence according to SEQ ID NO: 724 and the antisense strand comprises a modified nucleobase sequence according to SEQ ID NO: 712;

(aaaaaaaa) the sense strand comprises a modified nucleobase sequence according to SEQ ID NO: 726 and the antisense strand comprises a modified nucleobase sequence according to SEQ ID NO: 603;

(bbbbbbbb) the sense strand comprises a modified nucleobase sequence according to SEQ ID NO: 727 and the antisense strand comprises a modified nucleobase sequence according to SEQ ID NO: 596;

(cccccccc) the sense strand comprises a modified nucleobase sequence according to SEQ ID NO: 728 and the antisense strand comprises a modified nucleobase sequence according to SEQ ID NO: 703;

(dddddddd) the sense strand comprises a modified nucleobase sequence according to SEQ ID NO: 729 and the antisense strand comprises a modified nucleobase sequence according to SEQ ID NO: 701;

(eeeeeeee) the sense strand comprises a modified nucleobase sequence according to SEQ ID NO: 730 and the antisense strand comprises a modified nucleobase sequence according to SEQ ID NO: 595; or (ffffffff) the sense strand comprises a modified nucleobase sequence according to SEQ ID NO: 731 and the antisense strand comprises a modified nucleobase sequence according to SEQ ID NO: 704.

Embodiment 171. The method or use of embodiment 170, wherein:

(a) the sense strand comprises a modified nucleobase sequence according to SEQ ID NO: 676 and the antisense strand comprises a modified nucleobase sequence according to SEQ ID NO: 603;

(b) the sense strand comprises a modified nucleobase sequence according to SEQ ID NO: 669 and the antisense strand comprises a modified nucleobase sequence according to SEQ ID NO: 596;

(c) the sense strand comprises a modified nucleobase sequence according to SEQ ID NO: 715 and the antisense strand comprises a modified nucleobase sequence according to SEQ ID NO: 703;

(d) the sense strand comprises a modified nucleobase sequence according to SEQ ID NO: 713 and the antisense strand comprises a modified nucleobase sequence according to SEQ ID NO: 701;

(e) the sense strand comprises a modified nucleobase sequence according to SEQ ID NO: 668 and the antisense strand comprises a modified nucleobase sequence according to SEQ ID NO: 595;

(f) the sense strand comprises a modified nucleobase sequence according to SEQ ID NO: 716 and the antisense strand comprises a modified nucleobase sequence according to SEQ ID NO: 704;

(g) the sense strand comprises a modified nucleobase sequence according to SEQ ID NO: 726 and the antisense strand comprises a modified nucleobase sequence according to SEQ ID NO: 603;

(h) the sense strand comprises a modified nucleobase sequence according to SEQ ID NO: 727 and the antisense strand comprises a modified nucleobase sequence according to SEQ ID NO: 596;

(i) the sense strand comprises a modified nucleobase sequence according to SEQ ID NO: 728 and the antisense strand comprises a modified nucleobase sequence according to SEQ ID NO: 703;

(j) the sense strand comprises a modified nucleobase sequence according to SEQ ID NO: 729 and the antisense strand comprises a modified nucleobase sequence according to SEQ ID NO: 701;

(k) the sense strand comprises a modified nucleobase sequence according to SEQ ID NO: 730 and the antisense strand comprises a modified nucleobase sequence according to SEQ ID NO: 595; or (l) the sense strand comprises a modified nucleobase sequence according to SEQ ID NO: 731 and the antisense strand comprises a modified nucleobase sequence according to SEQ ID NO: 704.

Embodiment 172. The method or use of embodiment 171, wherein the RNAi agent comprises a targeting ligand comprising a structure according to Formula I:

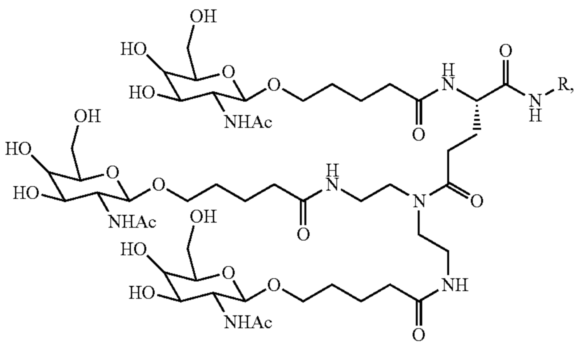

wherein R is a linker conjugated to the wherein the targeting ligand is conjugated to the 3' end of the sense strand, wherein R comprises a structure according to Formula III:

Formula III

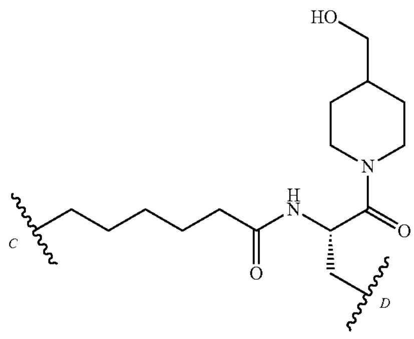

and wherein connection point C of Formula III is conjugated to Formula I, and connection point D of Formula III is conjugated to the 3' end of the sense strand.

Embodiment 173. The method or use of any one of embodiments 118-170, wherein the sense strand comprises a 3' overhang of 1-5 nucleotides in length.

Embodiment 174. The method or use of any one of embodiments 118-170 and 173, wherein the sense strand comprises a 5' overhang of 1-5 nucleotides in length.

Embodiment 175. The method or use of any one of embodiments 118-170, wherein the antisense strand comprises a 3' overhang of 1-5 nucleotides in length.

176. The method or use of any one of embodiments 118-170 and 175, wherein the antisense strand comprises a 5' overhang of 1-5 nucleotides in length.

Embodiment 177. The method or use of any one of embodiments 118-176, wherein the sense strand or the antisense strand comprises at least one modified nucleotide or at least one modified internucleoside linkage.

Embodiment 178. The method or use of embodiment 177, wherein the sense strand and or the antisense strand comprises a modified internucleoside linkage at a first, second, penultimate, or final internucleoside linkage position.

Embodiment 179. The method or use of embodiment 177 or 178, wherein the at least one modified nucleotide or at least one modified internucleoside linkage comprises a 2'-O-methyl modified nucleotide, a nucleotide comprising a 5'-phosphorothioate group, a 2'-deoxy-2'-fluoro modified nucleotide, a 2'-deoxy-modified nucleotide, a locked nucleotide, an abasic nucleotide, deoxythymidine, an inverted deoxythymidine, a 2'-amino-modified nucleotide, a 2'-alkyl-modified nucleotide, a morpholino nucleotide, a phosphoramidate, or a non-natural base comprising nucleotide.

Embodiment 180. The method or use of any one of embodiments 131-170 and 173-179, wherein the targeting ligand is conjugated to the sense strand.

Embodiment 181. The method or use of embodiment 180, wherein the targeting ligand is conjugated to the 3' end of the sense strand.

Embodiment 182. The method or use of embodiment 180, wherein the targeting ligand is conjugated to the 5' end of the sense strand.

Embodiment 183. The method or use of any one of embodiments 131-170 and 173-178, wherein the targeting ligand is conjugated to the antisense strand.

Embodiment 184. The method or use of embodiment 183, wherein the targeting ligand is conjugated to the 3' end of the antisense strand.

Embodiment 185. The method or use of embodiment 183, wherein the targeting ligand is conjugated to the 5' end of the antisense strand.

Embodiment 186. The method or use of any one of embodiments 131-170 and 173-185, wherein the targeting ligand comprises a galactose trimer.

Embodiment 187. The method or use of any one of embodiments 131-170 and 173-186, wherein the targeting ligand comprises N-acetylgalactosamine (GalNac).

Embodiment 188. The method or use of any one of embodiments 131-170 and 173-187, wherein the targeting ligand comprises a structure according to Formula I:

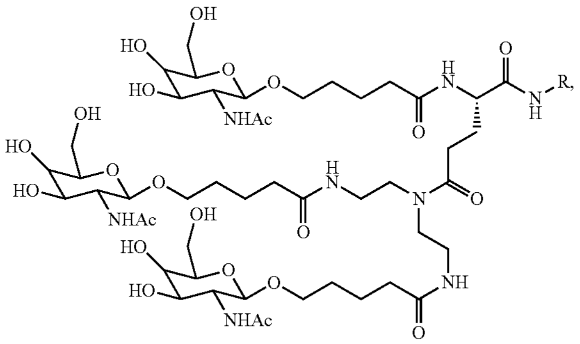

wherein R is:

(i) the sense strand or the antisense strand; or (ii) a linker conjugated to the sense strand or the antisense strand.

Embodiment 189. The method or use of embodiment 188, wherein R is a linker conjugated to the sense strand or the antisense strand having a structure according to Formula III:

Formula III

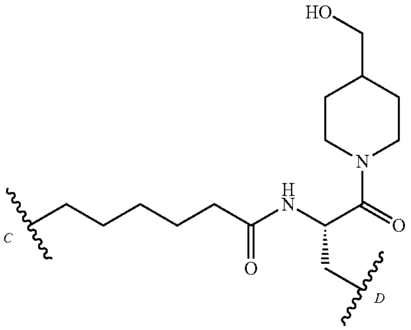

wherein:

(i) connection point C of Formula III is conjugated to Formula I, and connection point D of Formula III is conjugated to the sense strand or the antisense strand; or (ii) connection point C of Formula III is conjugated to Formula I, and connection point D of Formula III is conjugated to a phosphate group which is conjugated to the sense strand or the antisense strand.

Embodiment 190. The method or use of embodiment 189, wherein Formula III or the phosphate group is conjugated to the 3' end or 5' end of the sense strand or the antisense strand.

Embodiment 191. The method or use of embodiment 189, wherein Formula III or the phosphate group is conjugated to an internal nucleotide or nucleoside base of the sense strand or the antisense strand.

Embodiment 192. The method or use of any one of embodiments 131-170 and 173-187, wherein the RNAi agent comprises a targeting ligand and linker according to Formula V:

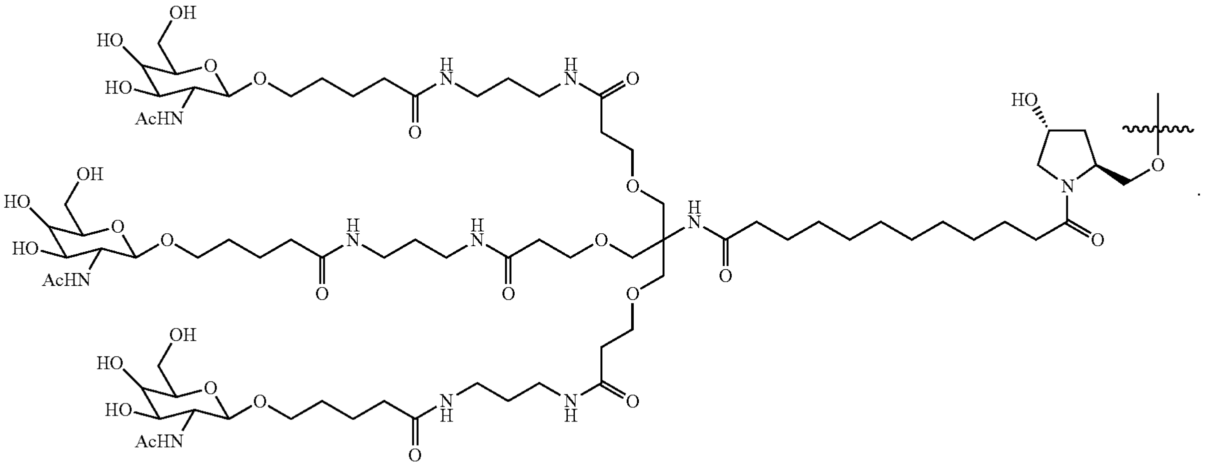 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

.

Embodiment 193. The method or use of any one of embodiments 118-192, wherein the RNAi agent is an siRNA molecule.

Embodiment 194. The method or use of any one of embodiments 118-192, wherein the RNAi agent is an shRNA molecule.

Embodiment 195. A method of producing the RNAi agent according to any one of embodiments 1-70, comprising annealing together the sense strand and the antisense strand.

Embodiment 196. The method or use of embodiment 195, comprising synthesizing the antisense strand and/or the sense strand.

VII. EXAMPLES

The following examples are included for illustrative purposes only and are not intended to limit the scope of the invention.

Example 1: Bioinformatic Based In Silico Design of siRNA Screening Set

In silico modeling enabled identification and selection of siRNA constructs that target human IRS-1. The selected siRNA candidates were also screened in silico for potential off-target reactivity and cross-reactivity including in human, cynomolgus monkey, rhesus monkey, mouse, and rat. The bioinformatic off-target prediction assumed a canonical 19 mer dsRNA structure. Positions 2-18 (5' to 3') of the sense and antisense strand were used for specificity calculations and positions 2-7 (5' to 3') were used for seed region analysis. Positions 1-19 (5' to 3') and positions 1-21 (5' to 3') of the antisense strand were used for cross-reactivity and human SNP analysis. All relevant sequences that target IRS-1 mRNA were identified and assembled in silico. Further cross-reactivity for human, cynomolgus monkey, rhesus monkey mouse, and rat analysis was conducted using all 19 basis or positions 2-18 of the sense strand, and all 21 bases or positions 2-20 of the antisense strand. Sense strands and antisense strands were analyzed separately.

For each candidate siRNA, the off-target frequency, classified by mismatch number, was calculated. The identity between seed region siRNA candidates and the seed region of known miRNAs was investigated to exclude siRNA candidates having identical seed regions to known miRNAs.

The siRNA candidates were analyzed against the NCBI SNP database to identify siRNAs targeting regions with known SNPs.

The thermodynamic profile of candidate SNPs was optimized by editing the sequences, for example by changing antisense strand position 1 to U and sense strand position 19 to A.

A total of 181 candidate siRNAs were selected based on the analysis. See duplexes including sense and antisense sequences in Table 3.

The 181 candidate siRNAs identified according to the method described in Example 1 were synthesized on approximately 0.2 μmol scale and purified using HPLC. Synthesized siRNA duplexes included 2'-fluoro and 2'-O-methyl-residues as well as phosphorothioate linkages at selected positions. See duplexes including modified sense and antisense sequences in Table 3.

Example 2: Determination of mRNA Inhibition by Selective RNAi Agents

This Example describes the testing of selective RNAi agents in a Hep2G cell line lysates with a reporter assay in order to determine the extent of the knockdown of the IRS1 gene by measuring mRNA expression. A branched DNA (bDNA) assay was used. The ten RNAi agents that result in the greatest knockdown percentage of IRS1 mRNA are selected for re-synthesis as GalNAc-conjugates as described in Example 3 below.

Example 3: Production and Efficacy of GalNAc Conjugates

This Example describes the GalNAc conjugation of the ten selected RNAi agents from Example 2. The sense strands of the RNAi agents are equipped with a triantennary GalNAc moiety on their 3'-ends, introduced by assembly on a commercially available GalNAc-loaded solid support (GalNAc-TEG cluster available through Primetech).

The GalNAc-conjugated RNAi agents are then tested for the ability to inhibit IRS1 mRNA in primary human hepatocytes (PHHs). The three GalNAc-conjugated RNAi agents that result in the greatest knockdown percentage of IRS1 mRNA in PHHs are selected for in vivo analysis of therapeutic efficacy as detailed in Example 4.

Example 4: RNAi Knockdown of Three Targets in Diet Induced Obesity Mouse Model One hundred, male, C57BL/6NTac DIO mice, 18 weeks of age, are obtained from Taconic Laboratories, singly housed, and acclimated to the vivarium for 14 days. A high fat diet (D12492) is fed to the animals upon arrival and throughout the study period. On Day −3, body weight is measured. Animals are assigned to groups within the study, ensuring there is no significant differences between groups with respect to body weight. On study Day 1, animals are dosed with a control, an siRNA, or vehicle via SC route.

On study Day 29, animals in Groups 1-8 are euthanized and maximum blood is collected via abdominal aorta and processed to serum. Terminal serum from all groups is analyzed for ALT, AST, TG, glucose, and liver triglycerides via plate based assay.

Mouse livers are harvested and weighed. The left lateral lobe (LLL) is collected in 10% NBF and processed to paraffin blocks. One slide is prepared from each block and stained with H&E. The slide is evaluated and scored by a CRL vet pathologist for liver steatosis. All H&E stained slides are scanned at 20× magnification. Left median lobe (LML) is collected in RNAlater. Approximately 50 mg tissue from right lateral lobe is weighed and snap-frozen for liver TG assay. All remaining liver is snap-frozen. Epididymal fat pads are harvested and weighed, one pad is collected in 10% NBF, processed to paraffin blocks for future analysis. The other fat pad is snap frozen.

Example 5: In Vitro Screening of RNAi Agents

This Example describes in vitro siRNA screening of selected IRS1 RNAi agents for their ability to inhibit IRS1 expression and their potency.

Evaluation of IRS1 Expression Via bDNA Assay

IRS1 gene expression knockdown following IRS1 RNAi agent transfection was determined by measuring mRNA expression. Specifically, an IRS1 mRNA specific bDNA assay was developed using Quantigene Singleplex (ThermoFisher Scientific Cat #QS0016) according to the manufacturer's protocol.

Briefly, HepG2 cells were transfected with 20 nM of each of the IRS1 RNAi constructs provided in Table 5, along with appropriate negative and positive controls. Cells were lysed 24 hours following transfection to produce HepG2 cell lysates, and mRNA expression of IRS1 was quantified relative to a housekeeping gene (GAPDH). Specifically, IRS1 knockdown was determined by normalizing to GAPDH, and determining fold change compared to vehicle controls (Table 5, right column).

TABLE 5

IRS1 gene expression as determined by bDNA assay following transfection with exemplary IRS1 RNAi pairs in vitro.

| Duplex ID NO: | Modified Sense Sequence (5'→3') | Modified Antisense Sequence (5'→3') | % knockdown (KD) |
|---|---|---|---|
| 17 | cscsgagcGfcGfGfAfggcuccguscsa (SEQ ID NO: 289) | usGfsacgGfagccuccGfcGfcucggscsa (SEQ ID NO: 193) | 0.0 |

TABLE 5-continued

IRS1 gene expression as determined by bDNA assay following transfection with exemplary IRS1 RNAi pairs in vitro.

| Duplex ID NO: | Modified Sense Sequence (5'→3') | Modified Antisense Sequence (5'→3') | % knockdown (KD) |
|---|---|---|---|
| 21 | gscsgcggAfgGfCfUfccgucacgsusa (SEQ ID NO: 290) | usAfscguGfacggagcCfuCfcgcgcsusc (SEQ ID NO: 194) | 2.1 |
| 28 | gsgscuccGfuCfAfCfguguuuuuscsa (SEQ ID NO: 291) | usGfsaaaAfacacgugAfcGfgagccsusc (SEQ ID NO: 195) | 6.6 |
| 83 | cscsggcgCfgCfAfGfagccagacsgsa (SEQ ID NO: 292) | usCfsgucUfggcucugCfgCfgccggscsc (SEQ ID NO: 196) | 0.0 |
| 95 | gscscagaCfgCfCfGfccgcuugususa (SEQ ID NO: 293) | usAfsacaAfgcggcggCfgUfcuggcsusc (SEQ ID NO: 197) | 8.8 |
| 96 | cscsagacGfcCfGfCfcgcuuguusua (SEQ ID NO: 294) | usAfsaacAfagcggcgGfcGfucuggscsu (SEQ ID NO: 198) | 13.6 |
| 97 | csasgacgCfcGfCfCfgcuuguuusua (SEQ ID NO: 295) | usAfsaaaCfaagcggcGfgCfgucugsgsc (SEQ ID NO: 199) | 1.1 |
| 102 | gscscgccGfcUfUfGfuuuugguusgsa (SEQ ID NO: 296) | usCfsaacCfaaaacaaGfcGfgcggcsgsu (SEQ ID NO: 200) | 16.9 |
| 103 | cscsgccgCfuUfGfUfuuugguugsgsa (SEQ ID NO: 297) | usCfscaaCfcaaaacaAfgCfggcggscsg (SEQ ID NO: 201) | 27.4 |
| 123 | gsgscucuCfgGfCfAfacucuccgsasa (SEQ ID NO: 298) | usUfscggAfgaguugcCfgAfgagccscsc (SEQ ID NO: 202) | 20.0 |
| 558 | gsasgaacCfcCfGfUfgcaacguusgsa (SEQ ID NO: 299) | usCfsaacGfuugcacgGfgGfuucucscsc (SEQ ID NO: 203) | 7.6 |
| 560 | gsasacccCfgUfGfCfaacguuggsgsa (SEQ ID NO: 300) | usCfscccaAfcguugcaCfgGfgguucsusc (SEQ ID NO: 204) | 15.1 |
| 561 | asascccCfGfuGfCfAfacguugggsasa (SEQ ID NO: 301) | usUfscccAfacguugcAfcGfgguuscsu (SEQ ID NO: 205) | 51.0 |
| 611 | usasuuuaAfuUfUfGfccucgggasasa (SEQ ID NO: 302) | usUfsuccCfgaggcaaAfuUfaaauasusc (SEQ ID NO: 206) | 0.7 |
| 744 | csgsacgaGfaGfAfUfgcaucuucsgsa (SEQ ID NO: 303) | usCfsgaaGfaugcaucUfcUfcgucgscsc (SEQ ID NO: 207) | 53.3 |
| 747 | csgsagagAfuGfCfAfucuucgcuscsa (SEQ ID NO: 304) | usGfsagcGfaagaugcAfuCfucucgsusc (SEQ ID NO: 208) | 29.8 |
| 795 | asgsacuuGfgCfUfCfucggaggasusa (SEQ ID NO: 305) | usAfsuccUfccgagagCfcAfagucuscsc (SEQ ID NO: 209) | 14.0 |
| 854 | gsgscgugAfaGfCfGfcccgaaaascsa (SEQ ID NO: 306) | usGfsuuuUfcgggcgcUfuCfacgccscsg (SEQ ID NO: 210) | 9.3 |
| 855 | gscsgugaAfgCfGfCfccgaaaacsusa (SEQ ID NO: 307) | usAfsguuUfucgggcgCfuUfcacgcscsc (SEQ ID NO: 211) | 14.5 |
| 856 | csgsugaaGfcGfCfCfcgaaaacuscsa (SEQ ID NO: 308) | usGfsaguUfuucgggcGfcUfucacgscsc (SEQ ID NO: 212) | 17.4 |
| 860 | asasgcgcCfcGfAfAfaacuccggsusa (SEQ ID NO: 309) | usAfsccgGfaguuuucGfgGfcgcuuscsa (SEQ ID NO: 213) | 4.0 |
| 863 | csgscccgAfaAfAfCfuccggucgsgsa (SEQ ID NO: 310) | usCfscgaCfcggaguuUfuCfgggcgscsu (SEQ ID NO: 214) | 31.8 |
| 864 | gscsccgaAfaAfCfUfccggucggsgsa (SEQ ID NO: 311) | usCfsccgAfccggaguUfuUfcgggcsgsc (SEQ ID NO: 215) | 26.7 |
| 865 | cscscgaaAfaCfUfCfcggucgggscsa (SEQ ID NO: 312) | usGfscccGfaccggagUfuUfucgggscsg (SEQ ID NO: 216) | 14.7 |
| 1098 | gsasgagcGfaUfGfGfcuucucggsasa (SEQ ID NO: 313) | usUfsccgAfgaagccaUfcGfcucucscsg (SEQ ID NO: 217) | 60.0 |

TABLE 5-continued

IRS1 gene expression as determined by bDNA assay following transfection with exemplary IRS1 RNAi pairs in vitro.

| Duplex ID NO: | Modified Sense Sequence (5'→3') | Modified Antisense Sequence (5'→3') | % knockdown (KD) |
|---|---|---|---|
| 1100 | gsasgcgaUfgGfCfUfucucggacsgsa (SEQ ID NO: 314) | usCfsgucCfgagaagcCfaUfcgcucsusc (SEQ ID NO: 218) | 42.3 |
| 1115 | gsgsacguGfcGfCfAfaggugggcsusa (SEQ ID NO: 315) | usAfsgccCfaccuugcGfcAfcguccsgsa (SEQ ID NO: 219) | 2.8 |
| 1116 | gsascgugCfgCfAfAfggugggcusasa (SEQ ID NO: 316) | usUfsagcCfcaccuugCfgCfacgucscsg (SEQ ID NO: 220) | 8.5 |
| 1131 | gsgscuacCfuGfCfGfcaaacccasasa (SEQ ID NO: 317) | usUfsuggGfuuugcgcAfgGfuagccscsa (SEQ ID NO: 221) | 26.2 |
| 1152 | asgscaugCfaCfAfAfacgcuucusua (SEQ ID NO: 318) | usAfsagaAfgcguuugUfgCfaugcuscsu (SEQ ID NO: 222) | 61.3 |
| 1156 | usgscacaAfaCfGfCfuucuucgusasa (SEQ ID NO: 319) | usUfsacgAfagaagcgUfuUfgugcasusg (SEQ ID NO: 223) | 50.0 |
| 1158 | csascaaaCfgCfUfUfcuucguacsusa (SEQ ID NO: 320) | usAfsguaCfgaagaagCfgUfuugugscsa (SEQ ID NO: 224) | 58.2 |
| 1203 | cscsggcgCfgCfCfUfcgaguacusasa (SEQ ID NO: 321) | usUfsaguAfcucgaggCfgCfgccggsgsc (SEQ ID NO: 225) | 15.4 |
| 1232 | gsasagaaGfuGfGfCfggcacaagsusa (SEQ ID NO: 322) | usAfscuuGfugccgccAfcUfucuucsusc (SEQ ID NO: 226) | 21.9 |
| 1233 | asasgaagUfgGfCfGfgcacaaguscsa (SEQ ID NO: 323) | usGfsacuUfgugccgcCfaCfuucuuscsu (SEQ ID NO: 227) | 5.6 |
| 1237 | asgsuggcGfgCfAfCfaagucgagscsa (SEQ ID NO: 324) | usGfscucGfacuugugCfcGfccacusu sc (SEQ ID NO: 228) | 20.4 |
| 1294 | ascsaucaAfcAfAfGfcgggcugascsa (SEQ ID NO: 325) | usGfsucaGfcccgcuuGfuUfgaugusu sg (SEQ ID NO: 229) | 12.4 |
| 1295 | csasucaaCfaAfGfCfgggcugacsusa (SEQ ID NO: 326) | usAfsgucAfgcccgcuUfgUfugaugsusu (SEQ ID NO: 230) | 0.0 |
| 1301 | csasagcgGfgCfUfGfacuccaagsasa (SEQ ID NO: 327) | usUfscuuGfgagucagCfcCfgcuugsusu (SEQ ID NO: 231) | 18.6 |
| 1411 | uscscuacAfgCfUfGfcacaaccgsusa (SEQ ID NO: 328) | usAfscggUfugugcagCfuGfuaggasgsa (SEQ ID NO: 232) | 36.8 |
| 1615 | ascscugaUfuGfGfUfaucuaccgscsa (SEQ ID NO: 329) | usGfscggUfagauaccAfaUfcaggusu sc (SEQ ID NO: 233) | 40.8 |
| 1704 | csusgaugAfaCfAfUfcaggcgcusgsa (SEQ ID NO: 330) | usCfsagcGfccugaugUfuCfaucagscsu (SEQ ID NO: 234) | 20.2 |
| 1891 | gscscaguCfcUfCfGfuccaacugscsa (SEQ ID NO: 331) | usGfscagUfuggacgaGfgAfcuggcsusc (SEQ ID NO: 235) | 21.0 |
| 2069 | csasgugaCfgGfCfGfaaggcaccsasa (SEQ ID NO: 332) | usUfsgguGfccuucgcCfgUfcacugsgsa (SEQ ID NO: 236) | 4.7 |
| 2071 | gsusgacgGfcGfAfAfggcaccausgsa (SEQ ID NO: 333) | usCfsaugGfugccuucGfcCfgucacsusg (SEQ ID NO: 237) | 0.0 |
| 2073 | gsascggcGfaAfGfGfcaccauguscsa (SEQ ID NO: 334) | usGfsacaUfggugccuUfcGfccgucsasc (SEQ ID NO: 238) | 7.8 |
| 2277 | gsgsccauGfgCfUfCfcaccucggsasa (SEQ ID NO: 335) | usUfsccgAfgguggagCfcAfuggccsasc (SEQ ID NO: 239) | 26.8 |
| 2286 | uscscaccUfcGfGfAfuugucucusua (SEQ ID NO: 336) | usAfsagaGfacaauccGfaGfguggasgsc (SEQ ID NO: 240) | 52.4 |
| 2313 | csuscuucCfcAfCfGfgcgaucuasgsa (SEQ ID NO: 337) | usCfsuagAfucgccguGfgGfaagagsasc (SEQ ID NO: 241) | 21.5 |

TABLE 5-continued

IRS1 gene expression as determined by bDNA assay following transfection with exemplary IRS1 RNAi pairs in vitro.

| Duplex ID NO: | Modified Sense Sequence (5'→3') | Modified Antisense Sequence (5'→3') | % knockdown (KD) |
|---|---|---|---|
| 2307 | cscsacggCfgAfUfCfuagugcuuscsa (SEQ ID NO: 338) | usGfsaagCfacuagauCfgCfcguggsgsa (SEQ ID NO: 242) | 45.8 |
| 2311 | gsgscgauCfuAfGfUfgcuucggusgsa (SEQ ID NO: 339) | usCfsaccGfaagcacuAfgAfucgccsgsu (SEQ ID NO: 243) | 14.8 |
| 2312 | gscsgaucUfaGfUfGfcuucggugsusa (SEQ ID NO: 340) | usAfscacCfgaagcacUfaGfaucgcscsg (SEQ ID NO: 244) | 46.4 |
| 2313 | csgsaucuAfgUfGfCfuucgguguscsa (SEQ ID NO: 341) | usGfsacaCfcgaagcaCfuAfgaucgscsc (SEQ ID NO: 245) | 39.2 |
| 2376 | gsgscuccAfgUfCfCfcugcgauusa (SEQ ID NO: 342) | usAfsaauCfgcagggaCfuGfgagccsasu (SEQ ID NO: 246) | 29.6 |
| 2379 | uscscaguCfcCfUfGfcgauuuccsgsa (SEQ ID NO: 343) | usCfsggaAfaucgcagGfgAfcuggasgsc (SEQ ID NO: 247) | 0.9 |
| 2464 | asgscuaaGfcAfAfCfuauaucugscsa (SEQ ID NO: 344) | usGfscagAfuauaguuGfcUfuagcuscsc (SEQ ID NO: 248) | 42.3 |
| 2524 | gsuscacuAfcAfUfUfuugucucgsgsa (SEQ ID NO: 345) | usCfscgaGfacaaaauGfuAfgugacscsg (SEQ ID NO: 249) | 55.3 |
| 2580 | ususgggcAfcGfAfGfuccagccususa (SEQ ID NO: 346) | usAfsaggCfuggacucGfuGfcccaasgsc (SEQ ID NO: 250) | 0.0 |
| 2640 | csgsguucCfgAfAfAfgagaacucsasa (SEQ ID NO: 347) | usUfsgagUfucucuuuCfgGfaaccgsasu (SEQ ID NO: 251) | 44.5 |
| 2715 | gsusggcuUfcCfAfUfugaggagusasa (SEQ ID NO: 348) | usUfsacuCfcucaaugGfaAfgccacsusg (SEQ ID NO: 252) | 15.2 |
| 3018 | asuscaucAfaUfCfCfcaucagacsgsa (SEQ ID NO: 349) | usCfsgucUfgaugggaUfuGfaugauscsu (SEQ ID NO: 253) | 56.7 |
| 3061 | asusggcuAfcAfUfGfaugaugucscsa (SEQ ID NO: 350) | usGfsgacAfucaucauGfuAfgccaususg (SEQ ID NO: 254) | 38.7 |
| 3369 | uscscuacUfaCfUfCfauugccaasgsa (SEQ ID NO: 351) | usCfsuugGfcaaugagUfaGfuaggasgsa (SEQ ID NO: 255) | 41.4 |
| 3390 | uscscuuuAfaGfCfAfcacccagcsgsa (SEQ ID NO: 352) | usCfsgcuGfggugugcUfuAfaaggasusc (SEQ ID NO: 256) | 32.2 |
| 3466 | csusggucGfcCfUfUfcucuaugcsusa (SEQ ID NO: 353) | usAfsgcaUfagagaagGfcGfaccagsasg (SEQ ID NO: 257) | 58.5 |
| 3605 | gscscucgAfaAfGfGfuggacacasgsa (SEQ ID NO: 354) | usCfsuguGfuccaccuUfuCfgaggcsasg (SEQ ID NO: 258) | 15.0 |
| 3620 | csascagcUfgCfUfCfagaccaausasa (SEQ ID NO: 355) | usUfsauuGfgucugagCfaGfcugugsusc (SEQ ID NO: 259) | 19.4 |
| 3623 | asgscugcUfcAfGfAfccaauagcscsa (SEQ ID NO: 356) | usGfsgcuAfuuggucuGfaGfcagcusgsu (SEQ ID NO: 260) | 8.9 |
| 3682 | asgsgccaGfcAfCfCfuuaccucgsgsa (SEQ ID NO: 357) | usCfscgaGfguaagguGfcUfggccususg (SEQ ID NO: 261) | 21.1 |
| 4295 | csusucacCfcGfGfGfugaaccucsasa (SEQ ID NO: 358) | usUfsgagGfuucacccGfgGfugaagsgsc (SEQ ID NO: 262) | 51.8 |
| 4308 | asasccucAfgUfCfCfuaaccgcasasa (SEQ ID NO: 359) | usUfsugcGfguuaggaCfuGfagguuscsa (SEQ ID NO: 263) | 60.4 |
| 4309 | ascscucaGfuCfCfUfaaccgcaascsa (SEQ ID NO: 360) | usGfsuugCfgguuaggAfcUfgaggususc (SEQ ID NO: 264) | 57.7 |
| 4311 | csuscaguCfcUfAfAfccgcaaccsasa (SEQ ID NO: 361) | usUfsgguUfgcgguuaGfgAfcugagsgsu (SEQ ID NO: 265) | 42.5 |

TABLE 5-continued

IRS1 gene expression as determined by bDNA assay following transfection with exemplary IRS1 RNAi pairs in vitro.

| Duplex ID NO: | Modified Sense Sequence (5'→3') | Modified Antisense Sequence (5'→3') | % knockdown (KD) |
|---|---|---|---|
| 4351 | csasgaccCfaCfAfAfgggugccgsgsa (SEQ ID NO: 362) | usCfscggCfacccuugUfgGfgucugscsa (SEQ ID NO: 266) | 14.7 |
| 4605 | asasugguCfuUfAfAfcuacauagsasa (SEQ ID NO: 363) | usUfscuaUfguaguaAfgAfccauuscsu (SEQ ID NO: 267) | 54.4 |
| 4747 | csasagugAfgGfAfUfuuaagcgcscsa (SEQ ID NO: 364) | usGfsgcgCfuuaaaucCfuCfacuugsasg (SEQ ID NO: 268) | 67.0 |
| 4762 | gscsgccuAfuGfCfCfagcaucagsusa (SEQ ID NO: 365) | usAfscugAfugcuggcAfuAfggcgcsusu (SEQ ID NO: 269) | 60.6 |
| 7504 | csasccaaCfcUfCfUfcacagcgususa (SEQ ID NO: 366) | usAfsacgCfugugagaGfgUfuggugsusc (SEQ ID NO: 270) | 16.5 |
| 7649 | asgsaaucCfaUfUfAfaugaucaascsa (SEQ ID NO: 367) | usGfsuugAfucauuaaUfgGfauucuscsu (SEQ ID NO: 271) | 7.8 |
| 7659 | asasugauCfaAfCfCfaccugaguscsa (SEQ ID NO: 368) | usGfsacuCfagguggUfgAfucauusasa (SEQ ID NO: 272) | 0.0 |
| 7663 | asuscaacCfaCfCfUfgagucaausasa (SEQ ID NO: 369) | usUfsauuGfacucaggUfgGfuugauscsa (SEQ ID NO: 273) | 14.8 |
| 8319 | gsasugaaUfgUfUfAfguuggaggsusa (SEQ ID NO: 370) | usAfsccuCfcaacuaaCfaUfucaucsasu (SEQ ID NO: 274) | 3.7 |
| 8324 | asusguuaGfuUfGfGfagguaaugscsa (SEQ ID NO: 371) | usGfscauUfaccuccaAfcUfaacaususc (SEQ ID NO: 275) | 1.3 |
| 8677 | usasugacCfuUfGfCfcaagacuasasa (SEQ ID NO: 372) | usUfsuagUfcuuggcaAfgGfucauasusu (SEQ ID NO: 276) | 11.7 |
| 8750 | asgsuagaAfcAfCfCfgaggauaasasa (SEQ ID NO: 373) | usUfsuuaUfccucgguGfuUfcuacuscsa (SEQ ID NO: 277) | 4.2 |
| 8939 | gsasuauuGfgAfGfGfugcuuaacscsa (SEQ ID NO: 374) | usGfsguuAfagcaccuCfcAfauaucsasu (SEQ ID NO: 278) | 0.0 |
| 8940 | asusauugGfaGfGfUfgcuuaaccscsa (SEQ ID NO: 375) | usGfsgguUfaagcaccUfcCfaauauscsa (SEQ ID NO: 279) | 2.0 |
| 9157 | ascsgaguAfuGfCfCfauaggauasgsa (SEQ ID NO: 376) | usCfsuauCfcuauggcAfuAfcucgususa (SEQ ID NO: 280) | 6.0 |
| 9164 | usgsccauAfgGfAfUfaggacaaasusa (SEQ ID NO: 377) | usAfsuuuGfuccuaucCfuAfuggcasusa (SEQ ID NO: 281) | 2.1 |
| 9265 | ususggcuUfaAfGfAfauguaguuscsa (SEQ ID NO: 378) | usGfsaacUfacauucuUfaAfgccaasusg (SEQ ID NO: 282) | 2.2 |
| 9266 | usgsgcuuAfaGfAfAfuguaguucscsa (SEQ ID NO: 379) | usGfsgaaCfuacauucUfuAfagccasasu (SEQ ID NO: 283) | 6.4 |
| 9327 | usgsgcuaCfaGfGfGfugggccaasasa (SEQ ID NO: 380) | usUfsuugGfcccacccUfgUfagccasasg (SEQ ID NO: 284) | 0.0 |
| 9333 | csasggguGfgGfCfCfaaauuaaascsa (SEQ ID NO: 381) | usGfsuuuAfauuuggcCfcAfcccugsusa (SEQ ID NO: 285) | 1.3 |
| 9453 | csasugguCfuGfUfAfuugcuaccsasa (SEQ ID NO: 382) | usUfsgguAfgcaauacAfgAfccaugscsa (SEQ ID NO: 286) | 0.0 |
| 9576 | ususuucuUfuAfUfAfguguuaugscsa (SEQ ID NO: 383) | usGfscauAfacacuauAfaAfgaaaascsu (SEQ ID NO: 287) | 1.2 |
| 9698 | usasuuagUfgGfUfCfcuuaauguscsa (SEQ ID NO: 384) | usGfsacaUfuaaggacCfaCfuaauasusu (SEQ ID NO: 288) | 0.0 |

Evaluation of IRS1 Expression Via qPCR Assay

IRS1 gene expression knockdown following IRS1 RNAi agent transfection was also determined by qPCR.

Briefly, HepG2 cells were transfected with 20 nM of each of the IRS1 RNAi provided in Table 6, along with appropriate negative and positive controls. Total RNA was extracted using a Qiagen RNeasy 96 Kit (Qiagen, Cat #74181) 72 hours post-transfection, which was subsequently converted to cDNA using SuperScript™ IV VILO™ reverse transcription mix. qRT-PCR was performed on the resulting cDNA using TaqMan™ probes for IRS1 and GAPDH. IRS1 fold change was calculated using the delta delta Ct method.

TABLE 6

IRS1 gene expression in HepG2 cells as determined by qPCR following transfection with exemplary IRS1 RNAi pairs in vitro.

| Duplex ID No. | Modified Sense Sequence (5'→3') | Modified Antisense Sequence (5'→3') | % knockdown (KD) |
|---|---|---|---|
| 1078 | gscsagcaUfgGfCfGfagcccuccsgsg (SEQ ID NO: 604) | csCfsggaGfggcucgcCfaUfgcugcscsa (SEQ ID NO: 531) | 27.5 |
| 1117 | ascsgugcGfcAfAfGfugggcuascsc (SEQ ID NO: 605) | gsGfsuagCfccaccuuGfcGfcacguscsc (SEQ ID NO: 532) | 0 |
| 1118 | csgsugcgCfaAfGfGfugggcuacscsu (SEQ ID NO: 606) | asGfsguaGfcccaccuUfgCfgcacgsusc (SEQ ID NO: 533) | 3.9 |
| 1148 | csasagagCfaUfGfCfacaaacgcsusu (SEQ ID NO: 607) | asAfsgcgUfuugugcaUfgCfucuugsgsg (SEQ ID NO: 534) | 29.9 |
| 1149 | asasgagcAfuGfCfAfcaaacgcusc (SEQ ID NO: 608) | gsAfsagcGfuuugugcAfuGfcucuusgsg (SEQ ID NO: 535) | 53.5 |
| 1154 | csasugcaCfaAfAfCfgcuucuucsgsu (SEQ ID NO: 609) | asCfsgaaGfaagcguuUfgUfgcaugscsu (SEQ ID NO: 536) | 68.9 |
| 1157 | gscsacaaAfcGfCfUfucuucguascsu (SEQ ID NO: 610) | asGfsuacGfaagaagcGfuUfugugcsasu (SEQ ID NO: 537) | 53.2 |
| 1228 | ascsgagaAfgAfAfGfuggcggcascsa (SEQ ID NO: 611) | usGfsugcCfgccacuuCfuUfcucgusus c (SEQ ID NO: 538) | 16.9 |
| 1230 | gsasgaagAfaGfUfGfgcggcacasasg (SEQ ID NO: 612) | csUfsuguGfccgccacUfuCfuucucsgsu (SEQ ID NO: 539) | 0 |
| 1234 | asgsaaguGfgCfGfGfcacaagucsgsa (SEQ ID NO: 613) | usCfsgacUfugugccgCfcAfcuucusus c (SEQ ID NO: 540) | 6.9 |
| 1235 | gsasagugGfcGfGfCfacaagucgsasg (SEQ ID NO: 614) | csUfscgaCfuugugccGfcCfacuucsusu (SEQ ID NO: 541) | 24.0 |
| 1236 | asasguggCfgGfCfAfcaagucgasgsc (SEQ ID NO: 615) | gsCfsucgAfcuugugcCfgCfcacuuscsu (SEQ ID NO: 542) | 32.0 |
| 1306 | gsgsgcugAfcUfCfCfaagaacaasgsc (SEQ ID NO: 616) | gsCfsuugUfucuuggaGfuCfagcccsgsc (SEQ ID NO: 543) | 47.3 |
| 1307 | gsgscugaCfuCfCfAfagaacaagscsa (SEQ ID NO: 617) | usGfscuuGfuucuuggAfgUfcagccscsg (SEQ ID NO: 544) | 32.7 |
| 1308 | gscsugacUfcCfAfAfgaacaagcsasc (SEQ ID NO: 618) | gsUfsgcuUfguucuugGfaGfucagcscsc (SEQ ID NO: 545) | 28.4 |
| 1316 | csasagaaCfaAfGfCfaccuggugsgsc (SEQ ID NO: 619) | gsCfscacCfaggugcuUfgUfucuugsgsa (SEQ ID NO: 546) | 6.4 |
| 1327 | ascscuggUfgGfCfUfcucuacacscsc (SEQ ID NO: 620) | gsGfsgugUfagagagcCfaCfcaggusgsc (SEQ ID NO: 547) | 33.7 |
| 1330 | usgsguggCfuCfUfCfuacacccgsgsg (SEQ ID NO: 621) | csCfscggGfuguagagAfgCfcaccasgsg (SEQ ID NO: 548) | 27.3 |
| 1384 | cscsgagcAfaGfAfCfagcugguascsc (SEQ ID NO: 622) | gsGfsuacCfagcugucUfuGfcucggscsc (SEQ ID NO: 549) | 27.4 |
| 1523 | gsgsacuuGfaGfCfUfacggugacsgsu (SEQ ID NO: 623) | asCfsgucAfccguagcUfcAfaguccsusc (SEQ ID NO: 550) | 40.2 |
| 1590 | cscscaagGfgCfCfUfgggucagascsa (SEQ ID NO: 624) | usGfsucuGfacccaggCfcCfuugggscsu (SEQ ID NO: 551) | 5.4 |
| 1599 | csusggguCfaGfAfCfaaagaaccsusg (SEQ ID NO: 625) | csAfsgguUfcuuugucUfgAfcccagsgsc (SEQ ID NO: 552) | 6.4 |

TABLE 6-continued

IRS1 gene expression in HepG2 cells as determined by qPCR following transfection with exemplary IRS1 RNAi pairs in vitro.

| Duplex ID No. | Modified Sense Sequence (5'→3') | Modified Antisense Sequence (5'→3') | % knockdown (KD) |
|---|---|---|---|
| 1600 | usgsggucAfgAfCfAfaagaaccusgsa (SEQ ID NO: 626) | usCfsaggUfucuuuguCfuGfacccasgsg (SEQ ID NO: 553) | 49.4 |
| 1614 | asasccugAfuUfGfGfuaucuaccsgsc (SEQ ID NO: 627) | gsCfsgguAfgauaccaAfuCfagguuscsu (SEQ ID NO: 554) | 58.9 |
| 1616 | cscsugauUfgGfUfAfucuaccgcscsu (SEQ ID NO: 628) | asGfsgcgGfuagauacCfaAfucaggsusu (SEQ ID NO: 555) | 77.1 |
| 1643 | gsasccagCfaAfGfAfccaucagcsusu (SEQ ID NO: 629) | asAfsgcuGfauggucuUfgCfuggucsasg (SEQ ID NO: 556) | 67.9 |
| 1747 | uscsaucgAfgGfUfGfggccguucsusg (SEQ ID NO: 630) | csAfsgaaCfggcccacCfuCfgaugasasg (SEQ ID NO: 557) | 29.4 |
| 1869 | gsasguucCfgCfCfCfucgcagcasasg (SEQ ID NO: 631) | csUfsugcUfgcgagggCfgGfaacucsasu (SEQ ID NO: 558) | 48.1 |
| 2074 | ascsggcgAfaGfGfCfaccaugucscsc (SEQ ID NO: 632) | gsGfsgacAfuggugccUfuCfgccguscsa (SEQ ID NO: 559) | 5.5 |
| 2185 | csgscucaAfcCfAfCfagccgcucscsa (SEQ ID NO: 633) | usGfsgagCfggcugugGfuUfgagcgsgsg (SEQ ID NO: 560) | 16.9 |
| 2285 | csusccacCfuCfGfGfauugucucsusu (SEQ ID NO: 634) | asAfsgagAfcaauccgAfgGfuggagscsc (SEQ ID NO: 561) | 57.8 |
| 2298 | usgsucucUfuCfCfCfacggcgauscsu (SEQ ID NO: 635) | asGfsaucGfccgugggAfaGfagacasasu (SEQ ID NO: 562) | 0 |
| 2304 | ususcccaCfgGfCfGfaucuagugscsu (SEQ ID NO: 636) | asGfscacUfagaucgcCfgUfgggaasgsa (SEQ ID NO: 563) | 38.82 |
| 2342 | csasgcgaUfgGfCfGfguuucaucsusc (SEQ ID NO: 637) | gsAfsgauGfaaaccgcCfaUfcgcugsgsg (SEQ ID NO: 564) | 0 |
| 2380 | cscsagucCfcUfGfCfgauuuccgsgsa (SEQ ID NO: 638) | usCfscggAfaaucgcaGfgGfacuggsasg (SEQ ID NO: 565) | 65.5 |
| 2382 | asgsucccUfgCfGfAfuuuccggasgsu (SEQ ID NO: 639) | asCfsuccGfgaaaucgCfaGfggacusgsg (SEQ ID NO: 566) | 0.7 |
| 2383 | gsusccuGfcGfAfUfuuccggagsusu (SEQ ID NO: 640) | asAfscucCfggaaaucGfcAfgggacsusg (SEQ ID NO: 567) | 0 |
| 2386 | cscsugcgAfuUfUfCfcggaguucscsu (SEQ ID NO: 641) | asGfsgaaCfuccggaaAfuCfgcaggsgsa (SEQ ID NO: 568) | 71.8 |
| 2399 | gsasguucCfuUfCfCfgcagugucsasc (SEQ ID NO: 642) | gsUfsgacAfcugcggaAfgGfaacucscsg (SEQ ID NO: 569) | 37.3 |
| 2406 | ususccgcAfgUfGfUfcacuccggsasu (SEQ ID NO: 643) | asUfsccgGfagugacaCfuGfcggaasgsg (SEQ ID NO: 570) | 0 |
| 2409 | csgscaguGfuCfAfCfuccggauuscsc (SEQ ID NO: 644) | gsGfsaauCfcggagugAfcAfcugcgsgsa (SEQ ID NO: 571) | 4.5 |
| 2749 | csusgccuAfcCfCfAfccaggaggsusg (SEQ ID NO: 645) | csAfsccuCfcugguggGfuAfggcagsgsc (SEQ ID NO: 572) | 21.9 |
| 2964 | gsgscaguGfgAfGfAfcuauaugcscsc (SEQ ID NO: 646) | gsGfsgcaUfauagucuCfcAfcugccscsu (SEQ ID NO: 573) | 28.59 |
| 2968 | gsusggagAfcUfAfUfaugcccausgsa (SEQ ID NO: 647) | usCfsaugGfgcauauaGfuCfuccacsusg (SEQ ID NO: 574) | 0.5 |
| 3019 | uscsaucaAfuCfCfCfaucagacgscsc (SEQ ID NO: 648) | gsGfscguCfugaugggAfuUfgaugasusc (SEQ ID NO: 575) | 65.6 |
| 3020 | csasucaaUfcCfCfAfucagacgcscsa (SEQ ID NO: 649) | usGfsgcgUfcugauggGfaUfugaugsasu (SEQ ID NO: 576) | 38.9 |

TABLE 6-continued

IRS1 gene expression in HepG2 cells as determined by qPCR following transfection with exemplary IRS1 RNAi pairs in vitro.

| Duplex ID No. | Modified Sense Sequence (5'→3') | Modified Antisense Sequence (5'→3') | % knockdown (KD) |
|---|---|---|---|
| 3259 | usasccuuGfcAfCfAfggugacuascsa (SEQ ID NO: 650) | usGfsuagUfcaccuguGfcAfagguasasg (SEQ ID NO: 577) | 25.9 |
| 3262 | csusugcaCfaGfGfUfgacuacausgsa (SEQ ID NO: 651) | usCfsaugUfagucaccUfgUfgcaagsgsu (SEQ ID NO: 578) | 51.9 |
| 3264 | usgscacaGfgUfGfAfcuacaugasasc (SEQ ID NO: 652) | gsUfsucaUfguagucaCfcUfgugcasasg (SEQ ID NO: 579) | 41.3 |
| 3266 | csascaggUfgAfCfUfacaugaacsasu (SEQ ID NO: 653) | asUfsguuCfauguaguCfaCfcugugscsa (SEQ ID NO: 580) | 42.6 |
| 3391 | cscsuuuaAfgCfAfCfacccagcgscsc (SEQ ID NO: 654) | gsGfscgcUfgggugugCfuUfaaaggsasu (SEQ ID NO: 581) | 37.9 |
| 3392 | csusuuaaGfcAfCfAfcccagcgcscsc (SEQ ID NO: 655) | gsGfsgcgCfuggguguGfcUfuaaagsgsa (SEQ ID NO: 582) | 44.0 |
| 3462 | asgscucuGfgUfCfGfccuucucusasu (SEQ ID NO: 656) | asUfsagaGfaaggcgaCfcAfgagcusasg (SEQ ID NO: 583) | 32.21 |
| 3623 | asgscugcUfcAfGfAfccaauagcscsg (SEQ ID NO: 657) | csGfsgcuAfuuggucuGfaGfcagcusgsu (SEQ ID NO: 584) | 0 |
| 3624 | gscsugcuCfaGfAfCfcaauagccsgsc (SEQ ID NO: 658) | gsCfsggcUfauuggucUfgAfgcagcsusg (SEQ ID NO: 585) | 63.5 |
| 4324 | gscsaaccAfgAfGfUfgccaaagusgsa (SEQ ID NO: 659) | usCfsacuUfuggcacuCfuGfguugcsgsg (SEQ ID NO: 586) | 1.5 |
| 4333 | gsusgccaAfaGfUfGfauccgugcsasg (SEQ ID NO: 660) | csUfsgcaCfggaucacUfuUfggcacsusc (SEQ ID NO: 587) | 61.5 |
| 4339 | asasgugaUfcCfGfUfgcagacccsasc (SEQ ID NO: 661) | gsUfsgggUfcugcacgGfaUfcacuusWsg (SEQ ID NO: 588) | 23.8 |
| 4604 | gsasauggUfcUfUfAfacuacauasgsa (SEQ ID NO: 662) | usCfsuauGfuaguuaaGfaCfcauucsusc (SEQ ID NO: 589) | 62.9 |
| 4737 | ascsccgcCfgCfUfCfaagugaggsasu (SEQ ID NO: 663) | asUfsccuCfacuugagCfgGfcgggusgsg (SEQ ID NO: 590) | 34.4 |
| 4738 | cscscgccGfcUfCfAfagugaggasusu (SEQ ID NO: 664) | asAfsuccUfcacuugaGfcGfgcgggsusg (SEQ ID NO: 591) | 0 |
| 4751 | usgsaggaUfuUfAfAfgcgccuausgsc (SEQ ID NO: 665) | gsCfsauaGfgcgcuuaAfaUfccucascsu (SEQ ID NO: 592) | 0 |
| 4753 | asgsgauuUfaAfGfCfgccuaugcscsa (SEQ ID NO: 666) | usGfsgcaUfaggcgcuUfaAfauccuscsa (SEQ ID NO: 593) | 0 |
| 4832 | gsasaugaAfgAfCfCfuaaaugacscsu (SEQ ID NO: 667) | asGfsgucAfuuuaggu CfuUfcauucsusg (SEQ ID NO: 594) | 79.9 |
| 4835 | usgsaagaCfcUfAfAfaugaccucsasg (SEQ ID NO: 668) | csUfsgagGfucauuuaGfgUfcuucasusu (SEQ ID NO: 595) | 86.0 |
| 4842 | csusaaauGfaCfCfUfcagcaaauscsc (SEQ ID NO: 669) | gsGfsauuUfgcugaggUfcAfuuuagsgsu (SEQ ID NO: 596) | 95. |
| 4896 | ususucauGfaUfUfCfacaacuagsgsa (SEQ ID NO: 670) | usCfscuaGfuugugaaUfcAfugaaasusa (SEQ ID NO: 597) | 86.9 |
| 4904 | ususcacaAfcUfAfGfgaccucausasu (SEQ ID NO: 671) | asUfsaugAfgguccuaGfuUfgugaasusc (SEQ ID NO: 598) | 86.2 |
| 4927 | uscscucaUfcAfGfUfagaugguascsg (SEQ ID NO: 672) | csGfsuacCfaucuacuGfaUfgaggasasg (SEQ ID NO: 599) | 83.5 |
| 4929 | csuscaucAfgUfAfGfaugguacgsasu (SEQ ID NO: 673) | asUfscguAfccaucuaCfuGfaugagsgsa (SEQ ID NO: 600) | 85.8 |

TABLE 6-continued

IRS1 gene expression in HepG2 cells as determined by qPCR following transfection with exemplary IRS1 RNAi pairs in vitro.

| Duplex ID No. | Modified Sense Sequence (5'→3') | Modified Antisense Sequence (5'→3') | % knockdown (KD) |
|---|---|---|---|
| 4931 | csasucagUfaGfAfUfgguacgausgsc (SEQ ID NO: 674) | gsCfsaucGfuaccaucUfaCfugaugsasg (SEQ ID NO: 601) | 76.9 |
| 4932 | asuscaguAfgAfUfGfguacgaugscsa (SEQ ID NO: 675) | usGfscauCfguaccauCfuAfcugausgsa (SEQ ID NO: 602) | 62.1 |
| 4933 | uscsaguaGfaUfGfGfuacgaugcsasu (SEQ ID NO: 676) | asUfsgcaUfcguaccaUfcUfacugasusg (SEQ ID NO: 603) | 96.2 |
| 4993 | csasuugaCfuGfAfAfcugcacgususc (SEQ ID NO: 713) | gsAfsacgUfgcaguucAfgUfcaaugsasa (SEQ ID NO: 701) | 90.2 |
| 4994 | asusugacUfgAfAfCfugcacguuscsu (SEQ ID NO: 714) | asGfsaacGfugcaguuCfaGfucaausgsa (SEQ ID NO: 702) | 82.4 |
| 4995 | ususgacuGfaAfCfUfgcacguucsusa (SEQ ID NO: 715) | usAfsgaaCfgugcaguUfcAfgucaasusg (SEQ ID NO: 703) | 90.7 |
| 5003 | ascsugcaCfgUfUfCfuauauugusgsc (SEQ ID NO: 716) | gsCfsacaAfuauagaaCfgUfgcagususc (SEQ ID NO: 704) | 85.5 |
| 5123 | gscsccacCfaCfCfGfugucaugasgsa (SEQ ID NO: 717) | usCfsucaUfgacacggUfgGfugggcsasc (SEQ ID NO: 705) | 31.4 |
| 5124 | cscscaccAfcCfGfUfgucaugagsasg (SEQ ID NO: 718) | csUfscucAfugacacgGfuGfgugggscsa (SEQ ID NO: 706) | 0 |
| 5418 | asgsuagaAfuAfGfGfguaugaucscsu (SEQ ID NO: 719) | asGfsgauCfauacccuAfuUfcuacuscsu (SEQ ID NO: 707) | 0 |
| 5468 | asusauaaGfaAfUfCfauagugccsasu (SEQ ID NO: 720) | asUfsggcAfcuaugauUfcUfuauaususa (SEQ ID NO: 708) | 0 |
| 5471 | usasagaaUfcAfUfAfgugccauasgsa (SEQ ID NO: 721) | usCfsuauGfgcacuauGfaUfucuuasusa (SEQ ID NO: 709) | 0 |
| 5512 | asusauuuGfcUfGfAfuacuaucuscsu (SEQ ID NO: 722) | asGfsagaUfaguaucaGfcAfaauausasa (SEQ ID NO: 710) | 0 |
| 5514 | asusuugcUfgAfUfAfcuaucucususg (SEQ ID NO: 723) | csAfsagaGfauaguauCfaGfcaaausasu (SEQ ID NO: 711) | 0 |
| 5838 | usasaacuAfgAfUfAfcuguugauscsu (SEQ ID NO: 724) | asGfsaucAfacaguauCfuAfguuuasusu (SEQ ID NO: 712) | 7.5 |

Potency

The ability of various IRS1 RNAi agents to inhibit IRS1 mRNA was evaluated in both HepG2 cells and pHH cells.

The sense strands of several exemplary IRS1 RNAi agents were first equipped with a triantennary GalNAc moiety on their 3'-ends, introduced by assembly on a commercially available GalNAc-loaded solid support (GalNAc-TEG cluster available through Primetech). The (GalNAc moiety)+ (linker) had the structure of either Formula IV or Formula V, as shown in Table 4. The resulting Formula IV or Formula V GalNAc-conjugated IRS1 RNAi agents (also referred to herein as "Formula IV IRS1 RNAi agents" or "Formula V IRS1 RNAi agents"), and parent IRS1 RNAi agents not conjugated to GalNAc (also referred to herein as "Parent IRS1 RNAi agents"), were transfected into HepG2 cells or pHH cells, and target gene expression was measured by qPCR using a TaqMan™ assay.

Briefly, HepG2 or pHH cells were transfected with the Formula IV or Formula V GalNac-conjugated IRS1 RNAi agents, or the respective parent IRS1 RNAi agents, in a dose response manner. Total RNA was extracted using a Qiagen RNeasy 96 Kit (Qiagen, Cat #74181) 72 hours post-transfection, which was subsequently converted to cDNA using SuperScript™ IV VILO™ reverse transcription mix. qRT-PCR was performed on the resulting cDNA using TaqMan™ probes for IRS1 and GAPDH. IRS1 fold change was calculated using the delta delta Ct method, and potency was determined based on IC50 values.

Figure 2A:
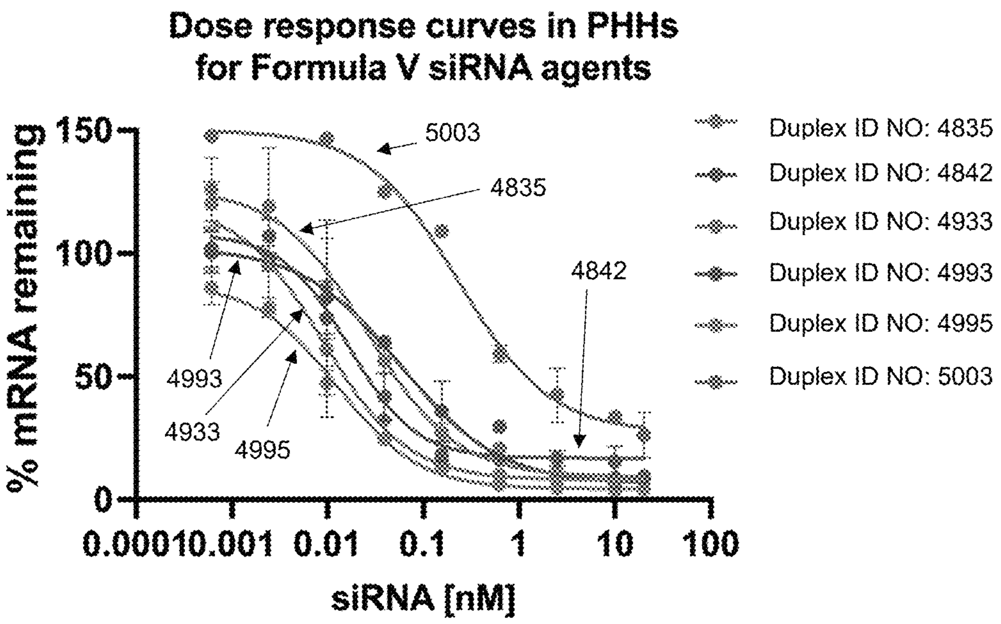
FIG. 2A shows dose dependent response curves in primary human hepatocytes (pHHs) for exemplary IRS1 siRNA agents conjugated to a targeting ligand according to Formula V.
Figure 2B:
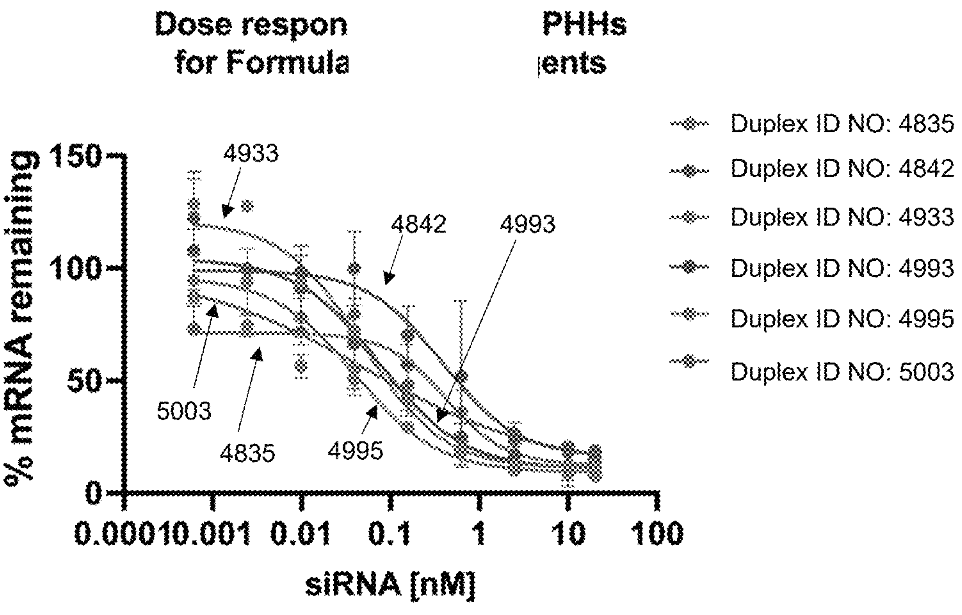
FIG. 2B shows dose dependent response curves in primary human hepatocytes (pHHs) for exemplary IRS1 siRNA agents conjugated to a targeting ligand according to Formula IV.
Figure 3:
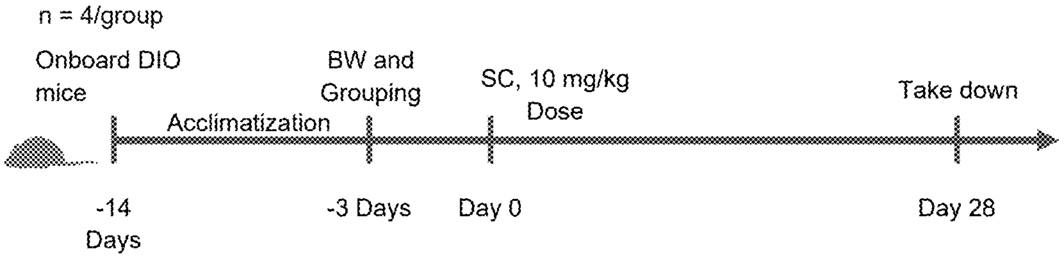
FIG. 3 depicts a schematic of an in vivo study schedule for mice treated with exemplary RNAi agents, as described in Example 6.

Table 7 shows potency of exemplary IRS1 RNAi pairs, with or without GalNAc Formula V conjugation in HepG2 cells, as well as potency of exemplary IRS1 RNAi pairs with GalNAc Formula IV (FIG. 2B) or Formula V (FIG. 2A) conjugation in pHH cells. Table 7 shows the modified antisense sequences for the parent IRS1 RNAi agents, Formula IV IRS1 RNAi agents, and Formula V IRS1 RNAi agents, as well as the modified sense sequences for the parent IRS1 RNAi agents. The modified sense sequences for the Formula IV IRS1 RNAi agents and Formula V IRS1 RNAi agents are shown with the modification pattern "nsnsnnnnNfnNfNfNfnnnnnnnnsnsn" (i.e., the second and third from the last nucleotides of 3'-end of the sense strand have 's' modifications), which is the proper modification pattern of the parent IRS1 RNAi agent sense sequence prior to conjugation with Formula IV or Formula V. In order to equip the parent IRS1 RNAi agent sense sequences with Formula IV or Formula V, the 's' modifications are removed from the second and third from the last nucleotides of 3'-end of the parent IRS1 RNAi agent sense sequences, thereby resulting in a modification pattern of "nsnsnnnnNfnNfNfNfnnnnnnnnnn" in modified sense sequences of both the Formula IV IRS1 RNAi agents and Formula V IRS1 RNAi agents.

TABLE 7

Potency of exemplary IRS1 RNAi pairs in vitro.

| Parent Duplex ID No. | Modified Sense Sequence (5'→3') | Modified Antisense Sequence (5'→3') | Parent IC50s (nM) in HepG2 | Formula V IC50s (nM) in HepG2 | Formula V IC50s (nM) in pHH | Formula IV IC50s (nM) in pHH |
|---|---|---|---|---|---|---|
| 4747 | csasagugAfgGfAfU fuuaagcgcscsa (SEQ ID NO: 364) | usGfsgcgCfuuaaau cCfuCfacuugsasg (SEQ ID NO: 268) | 0.006 | 0.006 | — | — |
| 1152 | asgscaugCfaCfAfA facgcuucususa (SEQ ID NO: 318) | usAfsagaAfgcguuu gUfgCfaugcuscsu (SEQ ID NO: 222) | — | 0.009 | — | 0.0085 |
| 4765 | gscsgccuAfuGfCfC fagcaucagsusa (SEQ ID NO: 365) | usAfscugAfugcugg cAfuAfggcgcsusu (SEQ ID NO: 269) | 0.002 | 0.002 | — | 0.0125 |
| 1098 | gsasgagcGfaUfGfG fcuucucggsasa (SEQ ID NO: 313) | usUfsccgAfgaagcca UfcGfcucucscsg (SEQ ID NO: 217) | — | 0.02 | — | — |
| 4308 | asasccucAfgUfCfC fuaaccgcasasa (SEQ ID NO: 359) | usUfsugcGfguuagg aCfuGfagguuscsa (SEQ ID NO: 263) | — | — | — | — |
| 1158 | csascaaaCfgCfUfU fcuucguacsusa (SEQ ID NO: 320) | usAfsguaCfgaagaa gCfgUfuugugscsa (SEQ ID NO: 224) | — | — | — | — |
| 3466 | csusggucGfcCfUfU fcucuaugcsusa (SEQ ID NO: 353) | usAfsgcaUfagagaa gGfcGfaccagsasg (SEQ ID NO: 257) | — | — | — | — |
| 4309 | ascscucaGfuCfCfU faaccgcaascsa (SEQ ID NO: 360) | usGfsuugCfgguuag gAfcUfgaggususc (SEQ ID NO: 264) | — | 0.004 | — | — |
| 3018 | asuscaucAfaUfCfC fcaucagacsgsa (SEQ ID NO: 349) | usCfsgucUfgauggg aUfuGfaugauscsu (SEQ ID NO: 253) | — | 0.002 | — | — |
| 2524 | gsuscacuAfcAfUfU fuugucucgsgsa (SEQ ID NO: 345) | usCfscgaGfacaaaau GfuAfgugacscsg (SEQ ID NO: 249) | — | — | — | — |
| 4832 | gsasaugaAfgAfCfC fuaaaugacscsu (SEQ ID NO: 667) | asGfsgucAfuuuagg uCfuUfcauucsusg (SEQ ID NO: 594) | 0.005 | — | — | — |
| 4835 | usgsaagaCfcUfAfA faugaccucsasg (SEQ ID NO: 668) | csUfsgagGfucauuu aGfgUfcuucasusu (SEQ ID NO: 595) | 0.064 | — | 0.026 | 0.42 |
| 4842 | csusaaauGfaCfCfU fcagcaaauscsc (SEQ ID NO: 669) | gsGfsauuUfgcugag gUfcAfuuuagsgsu (SEQ ID NO: 596) | 0.013 | — | 0.016 | 0.08 |
| 4896 | ususucauGfaUfUfC facaacuagsgsa (SEQ ID NO: 670) | usCfscuaGfuuguga aUfcAfugaaasusa (SEQ ID NO: 597) | 0.395 | — | 0.073 | — |
| 4904 | ususcacaAfcUfAfG fgaccucausasu (SEQ ID NO: 671) | asUfsaugAfgguccu aGfuUfgugaasusc (SEQ ID NO: 598) | 0.031 | — | 0.018 | — |

TABLE 7-continued

Potency of exemplary IRS1 RNAi pairs in vitro.

| Parent Duplex ID No. | Modified Sense Sequence (5'→3') | Modified Antisense Sequence (5'→3') | Parent IC50s (nM) in HepG2 | Formula V IC50s (nM) in HepG2 | Formula V IC50s (nM) in pHH | Formula IV IC50s (nM) in pHH |
|---|---|---|---|---|---|---|
| 4927 | uscscucaUfcAfGfU fagaugguascsg (SEQ ID NO: 672) | csGfsuacCfaucuacu GfaUfgaggasasg (SEQ ID NO: 599) | 0.116 | — | — | — |
| 4929 | csuscaucAfgUfAfG faugguacgsasu (SEQ ID NO: 673) | asUfscguAfccaucua CfuGfaugagsgsa (SEQ ID NO: 600) | 0.002 | — | — | — |
| 4933 | uscsaguaGfaUfGfG fuacgaugcsasu (SEQ ID NO: 676) | asUfsgcaUfcguacca UfcUfacugasusg (SEQ ID NO: 603) | 0.008 | — | 0.009 | 0.02 |
| 4993 | csasuugaCfuGfAfA fcugcacgususc (SEQ ID NO: 713) | gsAfsacgUfgcaguu cAfgUfcaaugsasa (SEQ ID NO: 701) | 0.058 | — | 0.057 | 0.09 |
| 4994 | asusugacUfgAfAfC fugcacguuscsu (SEQ ID NO: 714) | asGfsaacGfugcagu uCfaGfucaausgsa (SEQ ID NO: 702) | 0.031 | — | 0.021 | — |
| 4995 | ususgacuGfaAfCfU fgcacguucsusa (SEQ ID NO: 715) | usAfsgaaCfgugcag uUfcAfgucaasusg (SEQ ID NO: 703) | 0.034 | — | 0.012 | 0.03 |
| 5003 | ascsugcaCfgUfUfC fuauauugusgsc (SEQ ID NO: 716) | gsCfsacaA fuauagaa CfgUfgcagususc (SEQ ID NO: 704) | 0.050 | — | — | 0.58 |

Example 6: In Vivo Screening of RNAi Agents

This Example describes in vivo screening of selected IRS1 RNAi agents conjugated to for their ability to inhibit IRS1 expression and ability reduce liver fat in model mice.

Design of Exemplary IRS1 RNAi Agents

The sense strands of several exemplary IRS1 RNAi agents included a triantennary GalNAc moiety on their 3'-ends. The (GalNAc moiety)+ (linker) had the structure of Formula IV, as shown in Table 4. The resulting Formula IV GalNAc-conjugated IRS1 RNAi agents (also referred to herein as “Formula IV IRS1 RNAi agents”) were used to conduct in vivo experiments.

In Vivo Screening of Exemplary IRS1 RNAi Agents

Animal experiments were conducted in accordance with the Institutional Animal Care and Use Committee (IACUC) guidelines at Charles River, Massachusetts. A diet induced obese (DIO) mouse model was used to evaluate IRS1 gene expression knockdown and liver fat reduction following IRS1 RNAi agent transfection. Briefly, C57BL/6Ntac male mice were fed a 60% High fat diet (Research Diet #D12492) for 16 weeks. After acclimatization for 2 weeks, mice were administered subcutaneous injections of either phosphate buffer saline (PBS, pH 7.4) as a control, or 10 mg/kg of selected Formula IV IRS1 RNAi agents, and were fed the diet for an additional 4 weeks. After 4 weeks, the mice were sacrificed, their liver tissues were harvested, and the harvested liver tissue was stored at −80 °C for future analysis.

Figure 4A:
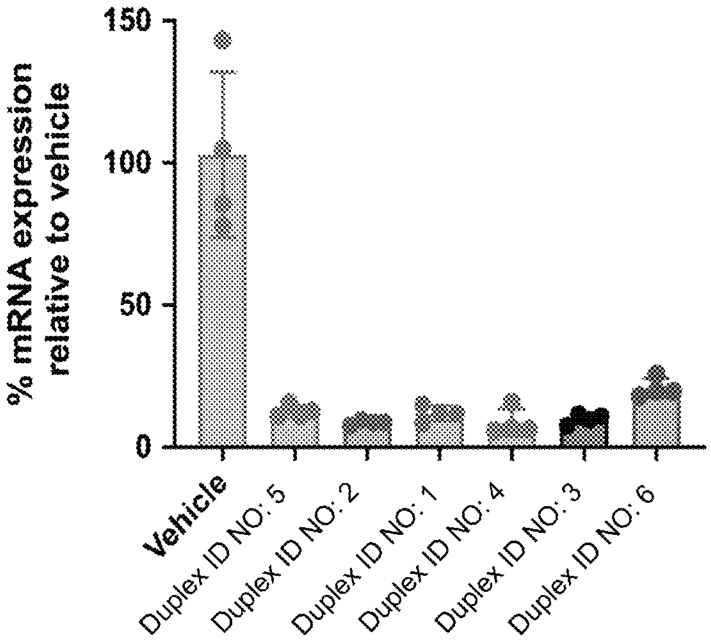
FIG. 4A shows a percent IRS1 mRNA expression compared to control vehicle in harvested liver tissue from mice on a high fat diet treated with exemplary IRS1 siRNA agents, as described in Example 6.

IRS1 gene expression knockdown at mRNA level in the harvested liver tissue was determined by qPCR (Table 8). Briefly, total RNA was extracted using a Qiagen RNeasy 96 Kit (Qiagen, Cat #74181), which was subsequently converted to cDNA using SuperScript™ IV VILO™ reverse transcription mix. qRT-PCR was performed on the resulting cDNA using TaqMan™ probes for IRS1 and GAPDH. IRS1 fold change was calculated using the delta delta Ct method (FIG. 4A).

Figure 4B:
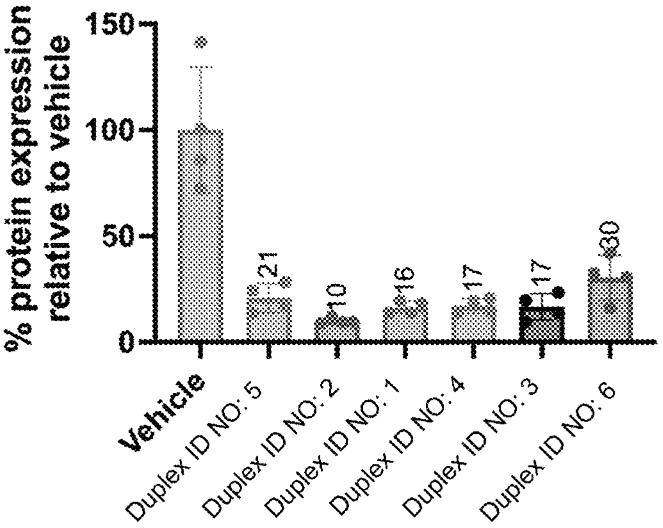
FIG. 4B shows a percent IRS1 polypeptide level compared to control vehicle in harvested liver tissue from mice on a high fat diet treated with exemplary IRS1 siRNA agents, as described in Example 6.

IRS1 protein expression was determined using manufacturer’s instructions based on a mesoscale discovery IRS1 chemiluminescence assay (FIG. 4B).

Percentage reduction in liver fat in mice treated with the selected Formula IV IRS1 RNAi agents relative to the percentage reduction in liver fact in mice treated with PBS measured using a colorimetric assay performed according to the manufacturer’s protocol (Triglyceride Colorimetric Assay Kit, Cayman Chemicals). As shown in Table 8, mice treated with each exemplary Formula IV IRS1 RNAi agents had reduced liver fat compared to mice treated with the PBS control.

TABLE 8

IRS1 gene expression as determined by qPCR and percentage liver fat reduction in mouse liver tissue relative to PBS vehicle control 4 weeks following treatment with exemplary Formula IV IRS1 RNAi agents in vivo.

| Duplex ID No. | Modified Sense Sequence (5'→3') | Modified Antisense Sequence (5'→3') | % knockdown (KD) | % reduction in liver fat relative to PBS |
|---|---|---|---|---|
| 5 | usgsaagaCfcUfAfAfaugaccucag (SEQ ID NO: 730) | csUfsgagGfucauuuaGfgUfcuucasusu (SEQ ID NO: 595) | 87 | −50 ± 8 |
| 2 | csusaaauGfaCfCfUfcagcaaaucc (SEQ ID NO: 727) | gsGfsauuUfgcugaggUfcAfuuuagsgsu (SEQ ID NO: 596) | 91 | −8 ± 16 |
| 1 | uscsaguaGfaUfGfGfuacgaugcau (SEQ ID NO: 726) | asUfsgcaUfcguaccaUfcUfacugasusg (SEQ ID NO: 603) | 88 | −61 ± 12 |
| 4 | csasuugaCfuGfAfAfcugcacguuc (SEQ ID NO: 729) | gsAfsacgUfgcaguucAfgUfcaaugsasa (SEQ ID NO: 701) | 91 | −61 ± 5 |
| 3 | ususgacuGfaAfCfUfgcacguucua (SEQ ID NO: 728) | usAfsgaaCfgugcaguUfcAfgucaasusg (SEQ ID NO: 703) | 90 | −40 ± 5 |
| 6 | ascsugcaCfgUfUfCfuauauugugc (SEQ ID NO: 731) | gsCfsacaAfuauagaaCfgUfgcagususc (SEQ ID NO: 704) | 79 | −51 ± 6 |

Figure 5:
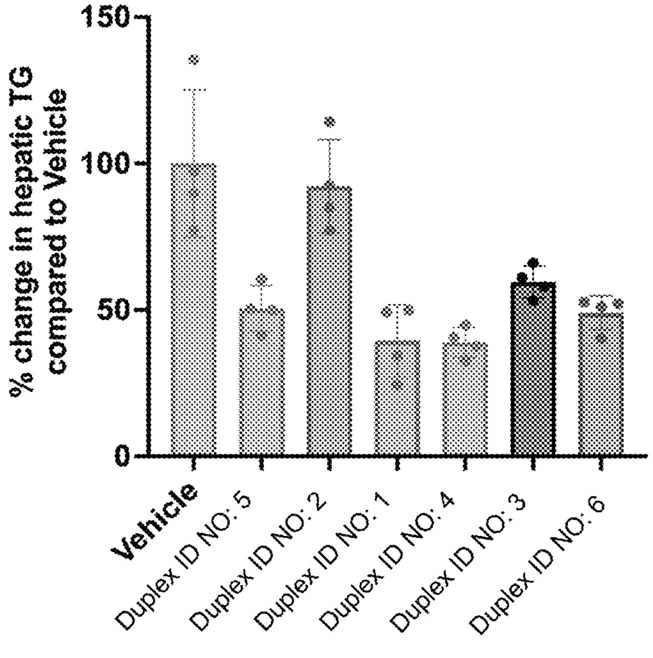
FIG. 5 shows a percent change in hepatic triglycerides compared to a control vehicle in mice on a high fat diet treated with exemplary IRS1 siRNA agents, as described in Example 6.

Serum alanine aminotransferase (ALT), aspartate aminotransferase (AST), cholesterol, and hepatic triglycerides were measured by colorimetric methods performed according to the manufacturer's protocol (Triglyceride Colorimetric Assay Kit, Cayman Chemicals). As shown in Table 9, mice treated with each exemplary Formula IV IRS1 RNAi agents had reduced serum ALT, AST, cholesterol, and triglycerides compared to mice treated with the PBS control. Percent change in hepatic triglycerides compared to control vehicle is shown in FIG. 5.

TABLE 9

Percentage serum ALT, AST, cholesterol, and triglyceride content in mice relative to PBS vehicle control 4 weeks following treatment with exemplary Formula IV IRS1 RNAi agents in vivo.

| Duplex ID No. | Modified Sense Sequence (5'→3') | Modified Antisense Sequence (5'→3') | % serum ALT relative to PBS | % serum AST relative to PBS | % serum cholesterol relative to PBS | % serum triglycerides relative to PBS |
|---|---|---|---|---|---|---|
| 5 | usgsaagaCfcUfAfAfaugaccucag (SEQ ID NO: 730) | csUfsgagGfucauuuaGfgUfcuucasusu (SEQ ID NO: 595) | −45 ± 11 | −18 ± 24 | −26 ± 7 | +26 ± 54 |
| 2 | csusaaauGfaCfCfUfcagcaaaucc (SEQ ID NO: 727) | gsGfsauuUfgcugaggUfcAfuuuagsgsu (SEQ ID NO: 596) | +35 ± 54 | +68 ± 46 | −47 ± 7 | −8 ± 37 |
| 1 | uscsaguaGfaUfGfGfuacgaugcau (SEQ ID NO: 726) | asUfsgcaUfcguaccaUfcUfacugasusg (SEQ ID NO: 603) | −60 ± 7 | −1 ± 17 | −18 ± 9 | −1 ± 27 |
| 4 | csasuugaCfuGfAfAfcugcacguuc (SEQ ID NO: 729) | gsAfsacgUfgcaguucAfgUfcaaugsasa (SEQ ID NO: 701) | −43 ± 18 | −13 ± 37 | −27 ± 9 | +37 ± 37 |

TABLE 9-continued

Percentage serum ALT, AST, cholesterol, and triglyceride content in mice relative to PBS vehicle control 4 weeks following treatment with exemplary Formula IV IRS1 RNAi agents in vivo.

| Duplex ID No. | Modified Sense Sequence (5'→3') | Modified Antisense Sequence (5'→3') | % serum ALT relative to PBS | % serum AST relative to PBS | % serum cholesterol relative to PBS | % serum triglycerides relative to PBS |
|---|---|---|---|---|---|---|
| 3 | ususgacuGfaAfCfUfgcacguucua (SEQ ID NO: 728) | usAfsgaaCfgugcaguUfcAfgucaasusg (SEQ ID NO: 703) | −15 ± 35 | −3 ± 39 | −16 ± 12 | −30 ± 25 |
| 6 | ascsugcaCfgUfUfCfuauauugugc (SEQ ID NO: 731) | gsCfsacaAfuauagaaCfgUfgcagususc (SEQ ID NO: 704) | −35 ± 21 | −21 ± 18 | −15 ± 6 | −6 ± 31 |

SEQUENCE LISTING (731 sequences)

SEQ ID NO: 1 - RNA, 23 nt, synthetic construct
  source 1..23: mol_type = other RNA
tgacggagcctccgcgctcggca

SEQ ID NO: 2 - RNA, 23 nt, synthetic construct
  source 1..23: mol_type = other RNA
tacgtgacggagcctccgcgctc

SEQ ID NO: 3 - RNA, 23 nt, synthetic construct
  source 1..23: mol_type = other RNA
tgaaaaacacgtgacggagcctc

SEQ ID NO: 4 - RNA, 23 nt, synthetic construct
  source 1..23: mol_type = other RNA
tcgtctggctctgcgcgccggcc

SEQ ID NO: 5 - RNA, 23 nt, synthetic construct
  source 1..23: mol_type = other RNA
taacaagcggcggcgtctggctc

SEQ ID NO: 6 - RNA, 23 nt, synthetic construct
  source 1..23: mol_type = other RNA
taaacaagcggcggcgtctggct

SEQ ID NO: 7 - RNA, 23 nt, synthetic construct
  source 1..23: mol_type = other RNA
taaaacaagcggcggcgtctggc

SEQ ID NO: 8 - RNA, 23 nt, synthetic construct
  source 1..23: mol_type = other RNA
tcaaccaaaacaagcggcggcgt

SEQ ID NO: 9 - RNA, 23 nt, synthetic construct
  source 1..23: mol_type = other RNA
tccaaccaaaacaagcggcggcg

SEQ ID NO: 10 - RNA, 23 nt, synthetic construct
  source 1..23: mol_type = other RNA
ttcggagagttgccgagagcccc

SEQ ID NO: 11 - RNA, 23 nt, synthetic construct
  source 1..23: mol_type = other RNA
tcaacgttgcacggggttctccc

SEQ ID NO: 12 - RNA, 23 nt, synthetic construct
  source 1..23: mol_type = other RNA
tcccaacgttgcacggggttctc

SEQ ID NO: 13 - RNA, 23 nt, synthetic construct
  source 1..23: mol_type = other RNA
ttcccaacgttgcacggggttct

SEQ ID NO: 14 - RNA, 23 nt, synthetic construct
  source 1..23: mol_type = other RNA
tttcccgaggcaaattaaatatc

SEQ ID NO: 15 - RNA, 23 nt, synthetic construct
  source 1..23: mol_type = other RNA
tcgaagatgcatctctcgtcgcc

SEQ ID NO: 16 - RNA, 23 nt, synthetic construct
  source 1..23: mol_type = other RNA
tgagcgaagatgcatctctcgtc

SEQ ID NO: 17 - RNA, 23 nt, synthetic construct
  source 1..23: mol_type = other RNA
tatcctccgagagccaagtctcc

SEQ ID NO: 18 - RNA, 23 nt, synthetic construct
  source 1..23: mol_type = other RNA
tgttttcgggcgcttcacgcccg

SEQ ID NO: 19 - RNA, 23 nt, synthetic construct
  source 1..23: mol_type = other RNA
tagttttcgggcgcttcacgccc

SEQ ID NO: 20 - RNA, 23 nt, synthetic construct
  source 1..23: mol_type = other RNA
tgagttttcgggcgcttcacgcc

SEQ ID NO: 21 - RNA, 23 nt, synthetic construct
  source 1..23: mol_type = other RNA
taccggagttttcgggcgcttca

SEQ ID NO: 22 - RNA, 23 nt, synthetic construct
  source 1..23: mol_type = other RNA
tccgaccggagttttcgggcgct

SEQ ID NO: 23 - RNA, 23 nt, synthetic construct
  source 1..23: mol_type = other RNA
tcccgaccggagttttcgggcgc

SEQ ID NO: 24 - RNA, 23 nt, synthetic construct
  source 1..23: mol_type = other RNA
tgcccgaccggagttttcgggcg

SEQ ID NO: 25 - RNA, 23 nt, synthetic construct
  source 1..23: mol_type = other RNA
ttccgagaagccatcgctctccg

SEQ ID NO: 26 - RNA, 23 nt, synthetic construct
  source 1..23: mol_type = other RNA
tcgtccgagaagccatcgctctc

SEQ ID NO: 27 - RNA, 23 nt, synthetic construct
  source 1..23: mol_type = other RNA
tagcccaccttgcgcacgtccga

SEQ ID NO: 28 - RNA, 23 nt, synthetic construct
  source 1..23: mol_type = other RNA
ttagcccaccttgcgcacgtccg

SEQ ID NO: 29 - RNA, 23 nt, synthetic construct
  source 1..23: mol_type = other RNA
tttgggtttgcgcaggtagccca

SEQ ID NO: 30 - RNA, 23 nt, synthetic construct
  source 1..23: mol_type = other RNA
taagaagcgtttgtgcatgctct

SEQ ID NO: 31 - RNA, 23 nt, synthetic construct
  source 1..23: mol_type = other RNA
ttacgaagaagcgtttgtgcatg

SEQ ID NO: 32 - RNA, 23 nt, synthetic construct
  source 1..23: mol_type = other RNA
tagtacgaagaagcgtttgtgca

SEQ ID NO: 33 - RNA, 23 nt, synthetic construct
  source 1..23: mol_type = other RNA
ttagtactcgaggcgcgccgggc

SEQ ID NO: 34 - RNA, 23 nt, synthetic construct
  source 1..23: mol_type = other RNA
tacttgtgccgccacttcttctc

SEQ ID NO: 35 - RNA, 23 nt, synthetic construct
  source 1..23: mol_type = other RNA
tgacttgtgccgccacttcttct

SEQ ID NO: 36 - RNA, 23 nt, synthetic construct
  source 1..23: mol_type = other RNA
tgctcgacttgtgccgccacttc

SEQ ID NO: 37 - RNA, 23 nt, synthetic construct
  source 1..23: mol_type = other RNA
tgtcagcccgcttgttgatgttg

SEQ ID NO: 38 - RNA, 23 nt, synthetic construct
  source 1..23: mol_type = other RNA
tagtcagcccgcttgttgatgtt

SEQ ID NO: 39 - RNA, 23 nt, synthetic construct
  source 1..23: mol_type = other RNA
ttcttggagtcagcccgcttgtt

SEQ ID NO: 40 - RNA, 23 nt, synthetic construct
  source 1..23: mol_type = other RNA
tacggttgtgcagctgtaggaga

SEQ ID NO: 41 - RNA, 23 nt, synthetic construct
  source 1..23: mol_type = other RNA
tgcggtagataccaatcaggttc

SEQ ID NO: 42 - RNA, 23 nt, synthetic construct
  source 1..23: mol_type = other RNA
tcagcgcctgatgttcatcagct

SEQ ID NO: 43 - RNA, 23 nt, synthetic construct
  source 1..23: mol_type = other RNA
tgcagttggacgaggactggctc

SEQ ID NO: 44 - RNA, 23 nt, synthetic construct
  source 1..23: mol_type = other RNA
ttggtgccttcgccgtcactgga

SEQ ID NO: 45 - RNA, 23 nt, synthetic construct
  source 1..23: mol_type = other RNA
tcatggtgccttcgccgtcactg

SEQ ID NO: 46 - RNA, 23 nt, synthetic construct
  source 1..23: mol_type = other RNA
tgacatggtgccttcgccgtcac

SEQ ID NO: 47 - RNA, 23 nt, synthetic construct
  source 1..23: mol_type = other RNA
ttccgaggtggagccatggccac

SEQ ID NO: 48 - RNA, 23 nt, synthetic construct
  source 1..23: mol_type = other RNA
taagagacaatccgaggtggagc

SEQ ID NO: 49 - RNA, 23 nt, synthetic construct
  source 1..23: mol_type = other RNA
tctagatcgccgtgggaagagac

SEQ ID NO: 50 - RNA, 23 nt, synthetic construct
  source 1..23: mol_type = other RNA
tgaagcactagatcgccgtggga

SEQ ID NO: 51 - RNA, 23 nt, synthetic construct
  source 1..23: mol_type = other RNA
tcaccgaagcactagatcgccgt

SEQ ID NO: 52 - RNA, 23 nt, synthetic construct
  source 1..23: mol_type = other RNA
tacaccgaagcactagatcgccg

SEQ ID NO: 53 - RNA, 23 nt, synthetic construct
  source 1..23: mol_type = other RNA
tgacaccgaagcactagatcgcc

SEQ ID NO: 54 - RNA, 23 nt, synthetic construct
  source 1..23: mol_type = other RNA
taaatcgcagggactggagccat

SEQ ID NO: 55 - RNA, 23 nt, synthetic construct
  source 1..23: mol_type = other RNA
tcggaaatcgcagggactggagc

SEQ ID NO: 56 - RNA, 23 nt, synthetic construct
  source 1..23: mol_type = other RNA
tgcagatatagttgcttagctcc

SEQ ID NO: 57 - RNA, 23 nt, synthetic construct
  source 1..23: mol_type = other RNA
tccgagacaaaatgtagtgaccg

SEQ ID NO: 58 - RNA, 23 nt, synthetic construct
  source 1..23: mol_type = other RNA
taaggctggactcgtgcccaagc

SEQ ID NO: 59 - RNA, 23 nt, synthetic construct
  source 1..23: mol_type = other RNA
ttgagttctctttcggaaccgat

SEQ ID NO: 60 - RNA, 23 nt, synthetic construct
  source 1..23: mol_type = other RNA
ttactcctcaatggaagccactg

SEQ ID NO: 61 - RNA, 23 nt, synthetic construct
  source 1..23: mol_type = other RNA
tcgtctgatgggattgatgatct

SEQ ID NO: 62 - RNA, 23 nt, synthetic construct
  source 1..23: mol_type = other RNA
tggacatcatcatgtagccattg

SEQ ID NO: 63 - RNA, 23 nt, synthetic construct
  source 1..23: mol_type = other RNA
tcttggcaatgagtagtaggaga

SEQ ID NO: 64 - RNA, 23 nt, synthetic construct
  source 1..23: mol_type = other RNA
tcgctgggtgtgcttaaaggatc

SEQ ID NO: 65 - RNA, 23 nt, synthetic construct
  source 1..23: mol_type = other RNA
tagcatagagaaggcgaccagag

SEQ ID NO: 66 - RNA, 23 nt, synthetic construct
  source 1..23: mol_type = other RNA
tctgtgtccacctttcgaggcag

SEQ ID NO: 67 - RNA, 23 nt, synthetic construct
  source 1..23: mol_type = other RNA
ttattggtctgagcagctgtgtc

SEQ ID NO: 68 - RNA, 23 nt, synthetic construct
  source 1..23: mol_type = other RNA
tggctattggtctgagcagctgt

SEQ ID NO: 69 - RNA, 23 nt, synthetic construct
  source 1..23: mol_type = other RNA
tccgaggtaaggtgctggccttg

SEQ ID NO: 70 - RNA, 23 nt, synthetic construct
  source 1..23: mol_type = other RNA
ttgaggttcacccgggtgaaggc

SEQ ID NO: 71 - RNA, 23 nt, synthetic construct
  source 1..23: mol_type = other RNA
tttgcggttaggactgaggttca

SEQ ID NO: 72 - RNA, 23 nt, synthetic construct
  source 1..23: mol_type = other RNA
tgttgcggttaggactgaggttc

SEQ ID NO: 73 - RNA, 23 nt, synthetic construct
  source 1..23: mol_type = other RNA
ttggttgcggttaggactgaggt

SEQ ID NO: 74 - RNA, 23 nt, synthetic construct
  source 1..23: mol_type = other RNA
tccggcacccttgtgggtctgca

SEQ ID NO: 75 - RNA, 23 nt, synthetic construct
  source 1..23: mol_type = other RNA
ttctatgtagttaagaccattct

SEQ ID NO: 76 - RNA, 23 nt, synthetic construct
  source 1..23: mol_type = other RNA
tggcgcttaaatcctcacttgag

SEQ ID NO: 77 - RNA, 23 nt, synthetic construct
  source 1..23: mol_type = other RNA
tactgatgctggcataggcgctt

SEQ ID NO: 78 - RNA, 23 nt, synthetic construct
  source 1..23: mol_type = other RNA
taacgctgtgagaggttggtgtc

SEQ ID NO: 79 - RNA, 23 nt, synthetic construct
  source 1..23: mol_type = other RNA
tgttgatcattaatggattctct

SEQ ID NO: 80 - RNA, 23 nt, synthetic construct
  source 1..23: mol_type = other RNA
tgactcaggtggttgatcattaa

SEQ ID NO: 81 - RNA, 23 nt, synthetic construct
  source 1..23: mol_type = other RNA
ttattgactcaggtggttgatca

SEQ ID NO: 82 - RNA, 23 nt, synthetic construct
  source 1..23: mol_type = other RNA
tacctccaactaacattcatcat

SEQ ID NO: 83 - RNA, 23 nt, synthetic construct
  source 1..23: mol_type = other RNA
tgcattacctccaactaacattc

SEQ ID NO: 84 - RNA, 23 nt, synthetic construct
  source 1..23: mol_type = other RNA
tttagtcttggcaaggtcatatt

SEQ ID NO: 85 - RNA, 23 nt, synthetic construct
  source 1..23: mol_type = other RNA
ttttatcctcggtgttctactca

SEQ ID NO: 86 - RNA, 23 nt, synthetic construct
  source 1..23: mol_type = other RNA
tggttaagcacctccaatatcat

SEQ ID NO: 87 - RNA, 23 nt, synthetic construct
  source 1..23: mol_type = other RNA
tgggttaagcacctccaatatca

SEQ ID NO: 88 - RNA, 23 nt, synthetic construct
  source 1..23: mol_type = other RNA
tctatcctatggcatactcgtta

SEQ ID NO: 89 - RNA, 23 nt, synthetic construct
  source 1..23: mol_type = other RNA
tatttgtcctatcctatggcata

SEQ ID NO: 90 - RNA, 23 nt, synthetic construct
  source 1..23: mol_type = other RNA
tgaactacattcttaagccaatg

SEQ ID NO: 91 - RNA, 23 nt, synthetic construct
  source 1..23: mol_type = other RNA
tggaactacattcttaagccaat

SEQ ID NO: 92 - RNA, 23 nt, synthetic construct
  source 1..23: mol_type = other RNA
ttttggcccaccctgtagccaag

SEQ ID NO: 93 - RNA, 23 nt, synthetic construct
  source 1..23: mol_type = other RNA
tgtttaatttggcccaccctgta

SEQ ID NO: 94 - RNA, 23 nt, synthetic construct
  source 1..23: mol_type = other RNA
ttggtagcaatacagaccatgca

SEQ ID NO: 95 - RNA, 23 nt, synthetic construct
  source 1..23: mol_type = other RNA
tgcataacactataaagaaaact

SEQ ID NO: 96 - RNA, 23 nt, synthetic construct
  source 1..23: mol_type = other RNA
tgacattaaggaccactaatatt

SEQ ID NO: 97 - RNA, 21 nt, synthetic construct
  source 1..21: mol_type = other RNA
ccgagcgcggaggctccgtca

SEQ ID NO: 98 - RNA, 21 nt, synthetic construct
  source 1..21: mol_type = other RNA
gcgcggaggctccgtcacgta

SEQ ID NO: 99 - RNA, 21 nt, synthetic construct
  source 1..21: mol_type = other RNA
ggctccgtcacgtgtttttca

SEQ ID NO: 100 - RNA, 21 nt, synthetic construct
  source 1..21: mol_type = other RNA
ccggcgcgcagagccagacga

SEQ ID NO: 101 - RNA, 21 nt, synthetic construct
  source 1..21: mol_type = other RNA
gccagacgccgccgcttgtta

SEQ ID NO: 102 - RNA, 21 nt, synthetic construct
  source 1..21: mol_type = other RNA
ccagacgccgccgcttgttta

SEQ ID NO: 103 - RNA, 21 nt, synthetic construct
  source 1..21: mol_type = other RNA
cagacgccgccgcttgtttta

SEQ ID NO: 104 - RNA, 21 nt, synthetic construct
  source 1..21: mol_type = other RNA
gccgccgcttgttttggttga

SEQ ID NO: 105 - RNA, 21 nt, synthetic construct
  source 1..21: mol_type = other RNA
ccgccgcttgttttggttgga

SEQ ID NO: 106 - RNA, 21 nt, synthetic construct
  source 1..21: mol_type = other RNA
ggctctcggcaactctccgaa

SEQ ID NO: 107 - RNA, 21 nt, synthetic construct
  source 1..21: mol_type = other RNA
gagaaccccgtgcaacgttga

SEQ ID NO: 108 - RNA, 21 nt, synthetic construct
  source 1..21: mol_type = other RNA
gaaccccgtgcaacgttggga

SEQ ID NO: 109 - RNA, 21 nt, synthetic construct
  source 1..21: mol_type = other RNA
aaccccgtgcaacgttgggaa

SEQ ID NO: 110 - RNA, 21 nt, synthetic construct
  source 1..21: mol_type = other RNA
tatttaatttgcctcgggaaa

SEQ ID NO: 111 - RNA, 21 nt, synthetic construct
  source 1..21: mol_type = other RNA
cgacgagagatgcatcttcga

SEQ ID NO: 112 - RNA, 21 nt, synthetic construct
  source 1..21: mol_type = other RNA
cgagagatgcatcttcgctca

SEQ ID NO: 113 - RNA, 21 nt, synthetic construct
  source 1..21: mol_type = other RNA
agacttggctctcggaggata

SEQ ID NO: 114 - RNA, 21 nt, synthetic construct
  source 1..21: mol_type = other RNA
ggcgtgaagcgcccgaaaaca

SEQ ID NO: 115 - RNA, 21 nt, synthetic construct
  source 1..21: mol_type = other RNA
gcgtgaagcgcccgaaaacta

SEQ ID NO: 116 - RNA, 21 nt, synthetic construct
  source 1..21: mol_type = other RNA
cgtgaagcgcccgaaaactca

SEQ ID NO: 117 - RNA, 21 nt, synthetic construct
  source 1..21: mol_type = other RNA
aagcgcccgaaaactccggta

SEQ ID NO: 118 - RNA, 21 nt, synthetic construct
  source 1..21: mol_type = other RNA
cgcccgaaaactccggtcgga

SEQ ID NO: 119 - RNA, 21 nt, synthetic construct
  source 1..21: mol_type = other RNA
gcccgaaaactccggtcggga

SEQ ID NO: 120 - RNA, 21 nt, synthetic construct
  source 1..21: mol_type = other RNA
cccgaaaactccggtcgggca

SEQ ID NO: 121 - RNA, 21 nt, synthetic construct
  source 1..21: mol_type = other RNA
gagagcgatggcttctcggaa

SEQ ID NO: 122 - RNA, 21 nt, synthetic construct
  source 1..21: mol_type = other RNA
gagcgatggcttctcggacga

SEQ ID NO: 123 - RNA, 21 nt, synthetic construct
  source 1..21: mol_type = other RNA
ggacgtgcgcaaggtgggcta

SEQ ID NO: 124 - RNA, 21 nt, synthetic construct
  source 1..21: mol_type = other RNA
gacgtgcgcaaggtgggctaa

SEQ ID NO: 125 - RNA, 21 nt, synthetic construct
  source 1..21: mol_type = other RNA
ggctacctgcgcaaacccaaa

SEQ ID NO: 126 - RNA, 21 nt, synthetic construct
  source 1..21: mol_type = other RNA
agcatgcacaaacgcttctta

SEQ ID NO: 127 - RNA, 21 nt, synthetic construct
  source 1..21: mol_type = other RNA
tgcacaaacgcttcttcgtaa

SEQ ID NO: 128 - RNA, 21 nt, synthetic construct
  source 1..21: mol_type = other RNA
cacaaacgcttcttcgtacta

SEQ ID NO: 129 - RNA, 21 nt, synthetic construct
  source 1..21: mol_type = other RNA
ccggcgcgcctcgagtactaa

SEQ ID NO: 130 - RNA, 21 nt, synthetic construct
  source 1..21: mol_type = other RNA
gaagaagtggcggcacaagta

SEQ ID NO: 131 - RNA, 21 nt, synthetic construct
  source 1..21: mol_type = other RNA
aagaagtggcggcacaagtca

SEQ ID NO: 132 - RNA, 21 nt, synthetic construct
  source 1..21: mol_type = other RNA
agtggcggcacaagtcgagca

SEQ ID NO: 133 - RNA, 21 nt, synthetic construct
  source 1..21: mol_type = other RNA
acatcaacaagcgggctgaca

SEQ ID NO: 134 - RNA, 21 nt, synthetic construct
  source 1..21: mol_type = other RNA
catcaacaagcgggctgacta

SEQ ID NO: 135 - RNA, 21 nt, synthetic construct
  source 1..21: mol_type = other RNA
caagcgggctgactccaagaa

SEQ ID NO: 136 - RNA, 21 nt, synthetic construct
  source 1..21: mol_type = other RNA
tcctacagctgcacaaccgta

SEQ ID NO: 137 - RNA, 21 nt, synthetic construct
  source 1..21: mol_type = other RNA
acctgattggtatctaccgca

SEQ ID NO: 138 - RNA, 21 nt, synthetic construct
  source 1..21: mol_type = other RNA
ctgatgaacatcaggcgctga

SEQ ID NO: 139 - RNA, 21 nt, synthetic construct
  source 1..21: mol_type = other RNA
gccagtcctcgtccaactgca

SEQ ID NO: 140 - RNA, 21 nt, synthetic construct
  source 1..21: mol_type = other RNA
cagtgacggcgaaggcaccaa

SEQ ID NO: 141 - RNA, 21 nt, synthetic construct
  source 1..21: mol_type = other RNA
gtgacggcgaaggcaccatga

SEQ ID NO: 142 - RNA, 21 nt, synthetic construct
  source 1..21: mol_type = other RNA
gacggcgaaggcaccatgtca

SEQ ID NO: 143 - RNA, 21 nt, synthetic construct
  source 1..21: mol_type = other RNA
ggccatggctccacctcggaa

SEQ ID NO: 144 - RNA, 21 nt, synthetic construct
  source 1..21: mol_type = other RNA
tccacctcggattgtctctta

SEQ ID NO: 145 - RNA, 21 nt, synthetic construct
  source 1..21: mol_type = other RNA
ctcttcccacggcgatctaga

SEQ ID NO: 146 - RNA, 21 nt, synthetic construct
  source 1..21: mol_type = other RNA
ccacggcgatctagtgcttca

SEQ ID NO: 147 - RNA, 21 nt, synthetic construct
  source 1..21: mol_type = other RNA
ggcgatctagtgcttcggtga

SEQ ID NO: 148 - RNA, 21 nt, synthetic construct
  source 1..21: mol_type = other RNA
gcgatctagtgcttcggtgta

SEQ ID NO: 149 - RNA, 21 nt, synthetic construct
  source 1..21: mol_type = other RNA
cgatctagtgcttcggtgtca

SEQ ID NO: 150 - RNA, 21 nt, synthetic construct
  source 1..21: mol_type = other RNA
ggctccagtccctgcgattta

SEQ ID NO: 151 - RNA, 21 nt, synthetic construct
  source 1..21: mol_type = other RNA
tccagtccctgcgatttccga

SEQ ID NO: 152 - RNA, 21 nt, synthetic construct
  source 1..21: mol_type = other RNA
agctaagcaactatatctgca

SEQ ID NO: 153 - RNA, 21 nt, synthetic construct
  source 1..21: mol_type = other RNA
gtcactacattttgtctcgga

SEQ ID NO: 154 - RNA, 21 nt, synthetic construct
  source 1..21: mol_type = other RNA
ttgggcacgagtccagcctta

SEQ ID NO: 155 - RNA, 21 nt, synthetic construct
  source 1..21: mol_type = other RNA
cggttccgaaagagaactcaa

SEQ ID NO: 156 - RNA, 21 nt, synthetic construct
  source 1..21: mol_type = other RNA
gtggcttccattgaggagtaa

SEQ ID NO: 157 - RNA, 21 nt, synthetic construct
  source 1..21: mol_type = other RNA
atcatcaatcccatcagacga

SEQ ID NO: 158 - RNA, 21 nt, synthetic construct
  source 1..21: mol_type = other RNA
atggctacatgatgatgtcca

SEQ ID NO: 159 - RNA, 21 nt, synthetic construct
  source 1..21: mol_type = other RNA
tcctactactcattgccaaga

SEQ ID NO: 160 - RNA, 21 nt, synthetic construct
  source 1..21: mol_type = other RNA
tcctttaagcacacccagcga

SEQ ID NO: 161 - RNA, 21 nt, synthetic construct
  source 1..21: mol_type = other RNA
ctggtcgccttctctatgcta

SEQ ID NO: 162 - RNA, 21 nt, synthetic construct
  source 1..21: mol_type = other RNA
gcctcgaaaggtggacacaga

SEQ ID NO: 163 - RNA, 21 nt, synthetic construct
  source 1..21: mol_type = other RNA
cacagctgctcagaccaataa

SEQ ID NO: 164 - RNA, 21 nt, synthetic construct
  source 1..21: mol_type = other RNA
agctgctcagaccaatagcca

SEQ ID NO: 165 - RNA, 21 nt, synthetic construct
  source 1..21: mol_type = other RNA
aggccagcaccttacctcgga

SEQ ID NO: 166 - RNA, 21 nt, synthetic construct
  source 1..21: mol_type = other RNA
cttcacccgggtgaacctcaa

SEQ ID NO: 167 - RNA, 21 nt, synthetic construct
  source 1..21: mol_type = other RNA
aacctcagtcctaaccgcaaa

SEQ ID NO: 168 - RNA, 21 nt, synthetic construct
  source 1..21: mol_type = other RNA
acctcagtcctaaccgcaaca

SEQ ID NO: 169 - RNA, 21 nt, synthetic construct
  source 1..21: mol_type = other RNA
ctcagtcctaaccgcaaccaa

SEQ ID NO: 170 - RNA, 21 nt, synthetic construct
  source 1..21: mol_type = other RNA
cagacccacaagggtgccgga

SEQ ID NO: 171 - RNA, 21 nt, synthetic construct
  source 1..21: mol_type = other RNA
aatggtcttaactacatagaa

SEQ ID NO: 172 - RNA, 21 nt, synthetic construct
  source 1..21: mol_type = other RNA
caagtgaggatttaagcgcca

SEQ ID NO: 173 - RNA, 21 nt, synthetic construct
  source 1..21: mol_type = other RNA
gcgcctatgccagcatcagta

SEQ ID NO: 174 - RNA, 21 nt, synthetic construct
  source 1..21: mol_type = other RNA
caccaacctctcacagcgtta

SEQ ID NO: 175 - RNA, 21 nt, synthetic construct
  source 1..21: mol_type = other RNA
agaatccattaatgatcaaca

SEQ ID NO: 176 - RNA, 21 nt, synthetic construct
  source 1..21: mol_type = other RNA
aatgatcaaccacctgagtca

SEQ ID NO: 177 - RNA, 21 nt, synthetic construct
  source 1..21: mol_type = other RNA
atcaaccacctgagtcaataa

SEQ ID NO: 178 - RNA, 21 nt, synthetic construct
  source 1..21: mol_type = other RNA
gatgaatgttagttggaggta

SEQ ID NO: 179 - RNA, 21 nt, synthetic construct
  source 1..21: mol_type = other RNA
atgttagttggaggtaatgca

SEQ ID NO: 180 - RNA, 21 nt, synthetic construct
  source 1..21: mol_type = other RNA
tatgaccttgccaagactaaa

SEQ ID NO: 181 - RNA, 21 nt, synthetic construct
  source 1..21: mol_type = other RNA
agtagaacaccgaggataaaa

SEQ ID NO: 182 - RNA, 21 nt, synthetic construct
  source 1..21: mol_type = other RNA
gatattggaggtgcttaacca

SEQ ID NO: 183 - RNA, 21 nt, synthetic construct
  source 1..21: mol_type = other RNA
atattggaggtgcttaaccca

SEQ ID NO: 184 - RNA, 21 nt, synthetic construct
  source 1..21: mol_type = other RNA
acgagtatgccataggataga

SEQ ID NO: 185 - RNA, 21 nt, synthetic construct
  source 1..21: mol_type = other RNA
tgccataggataggacaaata

SEQ ID NO: 186 - RNA, 21 nt, synthetic construct
  source 1..21: mol_type = other RNA
ttggcttaagaatgtagttca

SEQ ID NO: 187 - RNA, 21 nt, synthetic construct
  source 1..21: mol_type = other RNA
tggcttaagaatgtagttcca

SEQ ID NO: 188 - RNA, 21 nt, synthetic construct
  source 1..21: mol_type = other RNA
tggctacagggtgggccaaaa

SEQ ID NO: 189 - RNA, 21 nt, synthetic construct
  source 1..21: mol_type = other RNA
cagggtgggccaaattaaaca

SEQ ID NO: 190 - RNA, 21 nt, synthetic construct
  source 1..21: mol_type = other RNA
catggtctgtattgctaccaa

SEQ ID NO: 191 - RNA, 21 nt, synthetic construct
  source 1..21: mol_type = other RNA
ttttctttatagtgttatgca

SEQ ID NO: 192 - RNA, 21 nt, synthetic construct
  source 1..21: mol_type = other RNA
tattagtggtccttaatgtca

SEQ ID NO: 193 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgacggagcctccgcgctcggca

SEQ ID NO: 194 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tacgtgacggagcctccgcgctc

SEQ ID NO: 195 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgaaaaacacgtgacggagcctc

SEQ ID NO: 196 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcgtctggctctgcgcgccggcc

SEQ ID NO: 197 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
taacaagcggcggcgtctggctc

SEQ ID NO: 198 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
taaacaagcggcggcgtctggct

SEQ ID NO: 199 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
taaaacaagcggcggcgtctggc

SEQ ID NO: 200 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcaaccaaaacaagcggcggcgt

SEQ ID NO: 201 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tccaaccaaaacaagcggcggcg

SEQ ID NO: 202 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttcggagagttgccgagagcccc

SEQ ID NO: 203 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcaacgttgcacggggttctccc

SEQ ID NO: 204 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcccaacgttgcacggggttctc

SEQ ID NO: 205 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttcccaacgttgcacggggttct

SEQ ID NO: 206 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tttcccgaggcaaattaaatatc

SEQ ID NO: 207 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcgaagatgcatctctcgtcgcc

SEQ ID NO: 208 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgagcgaagatgcatctctcgtc

SEQ ID NO: 209 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tatcctccgagagccaagtctcc

SEQ ID NO: 210 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgttttcgggcgcttcacgcccg

SEQ ID NO: 211 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tagttttcgggcgcttcacgccc

SEQ ID NO: 212 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgagttttcgggcgcttcacgcc

SEQ ID NO: 213 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
taccggagttttcgggcgcttca

SEQ ID NO: 214 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tccgaccggagttttcgggcgct

SEQ ID NO: 215 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcccgaccggagttttcgggcgc

SEQ ID NO: 216 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgcccgaccggagttttcgggcg

SEQ ID NO: 217 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttccgagaagccatcgctctccg

SEQ ID NO: 218 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcgtccgagaagccatcgctctc

SEQ ID NO: 219 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tagcccaccttgcgcacgtccga

SEQ ID NO: 220 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttagcccaccttgcgcacgtccg

SEQ ID NO: 221 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tttgggtttgcgcaggtagccca

SEQ ID NO: 222 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
taagaagcgtttgtgcatgctct

SEQ ID NO: 223 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttacgaagaagcgtttgtgcatg

SEQ ID NO: 224 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tagtacgaagaagcgtttgtgca

SEQ ID NO: 225 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttagtactcgaggcgcgccgggc

SEQ ID NO: 226 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tacttgtgccgccacttcttctc

SEQ ID NO: 227 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgacttgtgccgccacttcttct

SEQ ID NO: 228 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgctcgacttgtgccgccacttc

SEQ ID NO: 229 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgtcagcccgcttgttgatgttg

SEQ ID NO: 230 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tagtcagcccgcttgttgatgtt

SEQ ID NO: 231 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttcttggagtcagcccgcttgtt

SEQ ID NO: 232 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tacggttgtgcagctgtaggaga

SEQ ID NO: 233 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgcggtagataccaatcaggttc

SEQ ID NO: 234 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcagcgcctgatgttcatcagct

SEQ ID NO: 235 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgcagttggacgaggactggctc

SEQ ID NO: 236 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttggtgccttcgccgtcactgga

SEQ ID NO: 237 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcatggtgccttcgccgtcactg

SEQ ID NO: 238 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgacatggtgccttcgccgtcac

SEQ ID NO: 239 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttccgaggtggagccatggccac

SEQ ID NO: 240 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
taagagacaatccgaggtggagc

SEQ ID NO: 241 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tctagatcgccgtgggaagagac

SEQ ID NO: 242 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgaagcactagatcgccgtggga

SEQ ID NO: 243 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcaccgaagcactagatcgccgt

SEQ ID NO: 244 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tacaccgaagcactagatcgccg

SEQ ID NO: 245 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgacaccgaagcactagatcgcc

SEQ ID NO: 246 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
taaatcgcagggactggagccat

SEQ ID NO: 247 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcggaaatcgcagggactggagc

SEQ ID NO: 248 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgcagatatagttgcttagctcc

SEQ ID NO: 249 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tccgagacaaaatgtagtgaccg

SEQ ID NO: 250 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
taaggctggactcgtgcccaagc

SEQ ID NO: 251 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttgagttctctttcggaaccgat

SEQ ID NO: 252 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttactcctcaatggaagccactg

SEQ ID NO: 253 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcgtctgatgggattgatgatct

SEQ ID NO: 254 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tggacatcatcatgtagccattg

SEQ ID NO: 255 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcttggcaatgagtagtaggaga

SEQ ID NO: 256 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcgctgggtgtgcttaaaggatc

SEQ ID NO: 257 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tagcatagagaaggcgaccagag

SEQ ID NO: 258 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tctgtgtccacctttcgaggcag

SEQ ID NO: 259 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttattggtctgagcagctgtgtc

SEQ ID NO: 260 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tggctattggtctgagcagctgt

SEQ ID NO: 261 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tccgaggtaaggtgctggccttg

SEQ ID NO: 262 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttgaggttcacccgggtgaaggc

SEQ ID NO: 263 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tttgcggttaggactgaggttca

SEQ ID NO: 264 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgttgcggttaggactgaggttc

SEQ ID NO: 265 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttggttgcggttaggactgaggt

SEQ ID NO: 266 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tccggcacccttgtgggtctgca

SEQ ID NO: 267 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttctatgtagttaagaccattct

SEQ ID NO: 268 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tggcgcttaaatcctcacttgag

SEQ ID NO: 269 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tactgatgctggcataggcgctt

SEQ ID NO: 270 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
taacgctgtgagaggttggtgtc

SEQ ID NO: 271 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgttgatcattaatggattctct

SEQ ID NO: 272 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgactcaggtggttgatcattaa

SEQ ID NO: 273 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttattgactcaggtggttgatca

SEQ ID NO: 274 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tacctccaactaacattcatcat

SEQ ID NO: 275 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgcattacctccaactaacattc

SEQ ID NO: 276 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tttagtcttggcaaggtcatatt

SEQ ID NO: 277 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttttatcctcggtgttctactca

SEQ ID NO: 278 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tggttaagcacctccaatatcat

SEQ ID NO: 279 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgggttaagcacctccaatatca

SEQ ID NO: 280 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tctatcctatggcatactcgtta

SEQ ID NO: 281 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tatttgtcctatcctatggcata

SEQ ID NO: 282 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgaactacattcttaagccaatg

SEQ ID NO: 283 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tggaactacattcttaagccaat

SEQ ID NO: 284 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttttggcccaccctgtagccaag

SEQ ID NO: 285 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgtttaatttggcccaccctgta

SEQ ID NO: 286 - RNA, 23 nt, synthetic construct
  modified_base 1: mod_base = OTHER; note = 2'-O-methyluridine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ttggtagcaatacagaccatgca

SEQ ID NO: 287 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgcataacactataaagaaaact

SEQ ID NO: 288 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgacattaaggaccactaatatt

SEQ ID NO: 289 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ccgagcgcggaggctccgtca

SEQ ID NO: 290 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcgcggaggctccgtcacgta

SEQ ID NO: 291 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggctccgtcacgtgtttttca

SEQ ID NO: 292 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ccggcgcgcagagccagacga

SEQ ID NO: 293 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gccagacgccgccgcttgtta

SEQ ID NO: 294 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ccagacgccgccgcttgttta

SEQ ID NO: 295 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cagacgccgccgcttgtttta

SEQ ID NO: 296 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gccgccgcttgttttggttga

SEQ ID NO: 297 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ccgccgcttgttttggttgga

SEQ ID NO: 298 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggctctcggcaactctccgaa

SEQ ID NO: 299 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gagaaccccgtgcaacgttga

SEQ ID NO: 300 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gaaccccgtgcaacgttggga

SEQ ID NO: 301 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aaccccgtgcaacgttgggaa

SEQ ID NO: 302 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tatttaatttgcctcgggaaa

SEQ ID NO: 303 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cgacgagagatgcatcttcga

SEQ ID NO: 304 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cgagagatgcatcttcgctca

SEQ ID NO: 305 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agacttggctctcggaggata

SEQ ID NO: 306 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggcgtgaagcgcccgaaaaca

SEQ ID NO: 307 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcgtgaagcgcccgaaaacta

SEQ ID NO: 308 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cgtgaagcgcccgaaaactca

SEQ ID NO: 309 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aagcgcccgaaaactccggta

SEQ ID NO: 310 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cgcccgaaaactccggtcgga

SEQ ID NO: 311 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcccgaaaactccggtcggga

SEQ ID NO: 312 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cccgaaaactccggtcgggca

SEQ ID NO: 313 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gagagcgatggcttctcggaa

SEQ ID NO: 314 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gagcgatggcttctcggacga

SEQ ID NO: 315 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggacgtgcgcaaggtgggcta

SEQ ID NO: 316 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gacgtgcgcaaggtgggctaa

SEQ ID NO: 317 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggctacctgcgcaaacccaaa

SEQ ID NO: 318 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agcatgcacaaacgcttctta

SEQ ID NO: 319 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tgcacaaacgcttcttcgtaa

SEQ ID NO: 320 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cacaaacgcttcttcgtacta

SEQ ID NO: 321 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ccggcgcgcctcgagtactaa

SEQ ID NO: 322 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gaagaagtggcggcacaagta

SEQ ID NO: 323 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aagaagtggcggcacaagtca

SEQ ID NO: 324 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agtggcggcacaagtcgagca

SEQ ID NO: 325 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
acatcaacaagcgggctgaca

SEQ ID NO: 326 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
catcaacaagcgggctgacta

SEQ ID NO: 327 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
caagcgggctgactccaagaa

SEQ ID NO: 328 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tcctacagctgcacaaccgta

SEQ ID NO: 329 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
acctgattggtatctaccgca

SEQ ID NO: 330 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctgatgaacatcaggcgctga

SEQ ID NO: 331 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gccagtcctcgtccaactgca

SEQ ID NO: 332 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cagtgacggcgaaggcaccaa

SEQ ID NO: 333 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gtgacggcgaaggcaccatga

SEQ ID NO: 334 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gacggcgaaggcaccatgtca

SEQ ID NO: 335 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggccatggctccacctcggaa

SEQ ID NO: 336 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tccacctcggattgtctctta

SEQ ID NO: 337 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctcttcccacggcgatctaga

SEQ ID NO: 338 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ccacggcgatctagtgcttca

SEQ ID NO: 339 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggcgatctagtgcttcggtga

SEQ ID NO: 340 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcgatctagtgcttcggtgta

SEQ ID NO: 341 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cgatctagtgcttcggtgtca

SEQ ID NO: 342 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggctccagtccctgcgattta

SEQ ID NO: 343 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tccagtccctgcgatttccga

SEQ ID NO: 344 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agctaagcaactatatctgca

SEQ ID NO: 345 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gtcactacattttgtctcgga

SEQ ID NO: 346 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ttgggcacgagtccagcctta

SEQ ID NO: 347 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cggttccgaaagagaactcaa

SEQ ID NO: 348 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gtggcttccattgaggagtaa

SEQ ID NO: 349 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
atcatcaatcccatcagacga

SEQ ID NO: 350 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
atggctacatgatgatgtcca

SEQ ID NO: 351 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tcctactactcattgccaaga

SEQ ID NO: 352 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tcctttaagcacacccagcga

SEQ ID NO: 353 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctggtcgccttctctatgcta

SEQ ID NO: 354 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcctcgaaaggtggacacaga

SEQ ID NO: 355 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cacagctgctcagaccaataa

SEQ ID NO: 356 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agctgctcagaccaatagcca

SEQ ID NO: 357 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aggccagcaccttacctcgga

SEQ ID NO: 358 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cttcacccgggtgaacctcaa

SEQ ID NO: 359 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aacctcagtcctaaccgcaaa

SEQ ID NO: 360 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
acctcagtcctaaccgcaaca

SEQ ID NO: 361 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctcagtcctaaccgcaaccaa

SEQ ID NO: 362 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cagacccacaagggtgccgga

SEQ ID NO: 363 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aatggtcttaactacatagaa

SEQ ID NO: 364 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
caagtgaggatttaagcgcca

SEQ ID NO: 365 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcgcctatgccagcatcagta

SEQ ID NO: 366 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
caccaacctctcacagcgtta

SEQ ID NO: 367 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agaatccattaatgatcaaca

SEQ ID NO: 368 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aatgatcaaccacctgagtca

SEQ ID NO: 369 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
atcaaccacctgagtcaataa

SEQ ID NO: 370 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gatgaatgttagttggaggta

SEQ ID NO: 371 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
atgttagttggaggtaatgca

SEQ ID NO: 372 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tatgaccttgccaagactaaa

SEQ ID NO: 373 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agtagaacaccgaggataaaa

SEQ ID NO: 374 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gatattggaggtgcttaacca

SEQ ID NO: 375 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
atattggaggtgcttaaccca

SEQ ID NO: 376 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
acgagtatgccataggataga

SEQ ID NO: 377 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tgccataggataggacaaata

SEQ ID NO: 378 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ttggcttaagaatgtagttca

SEQ ID NO: 379 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tggcttaagaatgtagttcca

SEQ ID NO: 380 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tggctacagggtgggccaaaa

SEQ ID NO: 381 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cagggtgggccaaattaaaca

SEQ ID NO: 382 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
catggtctgtattgctaccaa

SEQ ID NO: 383 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ttttctttatagtgttatgca

SEQ ID NO: 384 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tattagtggtccttaatgtca

SEQ ID NO: 385 - RNA, 23 nt, synthetic construct
  source 1..23: mol_type = other RNA
ccggagggctcgccatgctgcca

SEQ ID NO: 386 - RNA, 23 nt, synthetic construct
  source 1..23: mol_type = other RNA
ggtagcccaccttgcgcacgtcc

SEQ ID NO: 387 - RNA, 23 nt, synthetic construct
  source 1..23: mol_type = other RNA
aggtagcccaccttgcgcacgtc

SEQ ID NO: 388 - RNA, 23 nt, synthetic construct
  source 1..23: mol_type = other RNA
aagcgtttgtgcatgctcttggg

SEQ ID NO: 389 - RNA, 23 nt, synthetic construct
  source 1..23: mol_type = other RNA
gaagcgtttgtgcatgctcttgg

SEQ ID NO: 390 - RNA, 23 nt, synthetic construct
  source 1..23: mol_type = other RNA
acgaagaagcgtttgtgcatgct

SEQ ID NO: 391 - RNA, 23 nt, synthetic construct
  source 1..23: mol_type = other RNA
agtacgaagaagcgtttgtgcat

SEQ ID NO: 392 - RNA, 23 nt, synthetic construct
  source 1..23: mol_type = other RNA
tgtgccgccacttcttctcgttc

SEQ ID NO: 393 - RNA, 23 nt, synthetic construct
  source 1..23: mol_type = other RNA
cttgtgccgccacttcttctcgt

SEQ ID NO: 394 - RNA, 23 nt, synthetic construct
  source 1..23: mol_type = other RNA
tcgacttgtgccgccacttcttc

SEQ ID NO: 395 - RNA, 23 nt, synthetic construct
  source 1..23: mol_type = other RNA
ctcgacttgtgccgccacttctt

SEQ ID NO: 396 - RNA, 23 nt, synthetic construct
  source 1..23: mol_type = other RNA
gctcgacttgtgccgccacttct

SEQ ID NO: 397 - RNA, 23 nt, synthetic construct
  source 1..23: mol_type = other RNA
gcttgttcttggagtcagcccgc

SEQ ID NO: 398 - RNA, 23 nt, synthetic construct
  source 1..23: mol_type = other RNA
tgcttgttcttggagtcagcccg

SEQ ID NO: 399 - RNA, 23 nt, synthetic construct
  source 1..23: mol_type = other RNA
gtgcttgttcttggagtcagccc

SEQ ID NO: 400 - RNA, 23 nt, synthetic construct
  source 1..23: mol_type = other RNA
gccaccaggtgcttgttcttgga

SEQ ID NO: 401 - RNA, 23 nt, synthetic construct
  source 1..23: mol_type = other RNA
gggtgtagagagccaccaggtgc

SEQ ID NO: 402 - RNA, 23 nt, synthetic construct
  source 1..23: mol_type = other RNA
cccgggtgtagagagccaccagg

SEQ ID NO: 403 - RNA, 23 nt, synthetic construct
  source 1..23: mol_type = other RNA
ggtaccagctgtcttgctcggcc

SEQ ID NO: 404 - RNA, 23 nt, synthetic construct
  source 1..23: mol_type = other RNA
acgtcaccgtagctcaagtcctc

SEQ ID NO: 405 - RNA, 23 nt, synthetic construct
  source 1..23: mol_type = other RNA
tgtctgacccaggcccttgggct

SEQ ID NO: 406 - RNA, 23 nt, synthetic construct
  source 1..23: mol_type = other RNA
caggttctttgtctgacccaggc

SEQ ID NO: 407 - RNA, 23 nt, synthetic construct
  source 1..23: mol_type = other RNA
tcaggttctttgtctgacccagg

SEQ ID NO: 408 - RNA, 23 nt, synthetic construct
  source 1..23: mol_type = other RNA
gcggtagataccaatcaggttct

SEQ ID NO: 409 - RNA, 23 nt, synthetic construct
  source 1..23: mol_type = other RNA
aggcggtagataccaatcaggtt

SEQ ID NO: 410 - RNA, 23 nt, synthetic construct
  source 1..23: mol_type = other RNA
aagctgatggtcttgctggtcag

SEQ ID NO: 411 - RNA, 23 nt, synthetic construct
  source 1..23: mol_type = other RNA
cagaacggcccacctcgatgaag

SEQ ID NO: 412 - RNA, 23 nt, synthetic construct
  source 1..23: mol_type = other RNA
cttgctgcgagggcggaactcat

SEQ ID NO: 413 - RNA, 23 nt, synthetic construct
  source 1..23: mol_type = other RNA
gggacatggtgccttcgccgtca

SEQ ID NO: 414 - RNA, 23 nt, synthetic construct
  source 1..23: mol_type = other RNA
tggagcggctgtggttgagcggg

SEQ ID NO: 415 - RNA, 23 nt, synthetic construct
  source 1..23: mol_type = other RNA
aagagacaatccgaggtggagcc

SEQ ID NO: 416 - RNA, 23 nt, synthetic construct
  source 1..23: mol_type = other RNA
agatcgccgtgggaagagacaat

SEQ ID NO: 417 - RNA, 23 nt, synthetic construct
  source 1..23: mol_type = other RNA
agcactagatcgccgtgggaaga

SEQ ID NO: 418 - RNA, 23 nt, synthetic construct
  source 1..23: mol_type = other RNA
gagatgaaaccgccatcgctggg

SEQ ID NO: 419 - RNA, 23 nt, synthetic construct
  source 1..23: mol_type = other RNA
tccggaaatcgcagggactggag

SEQ ID NO: 420 - RNA, 23 nt, synthetic construct
  source 1..23: mol_type = other RNA
actccggaaatcgcagggactgg

SEQ ID NO: 421 - RNA, 23 nt, synthetic construct
  source 1..23: mol_type = other RNA
aactccggaaatcgcagggactg

SEQ ID NO: 422 - RNA, 23 nt, synthetic construct
  source 1..23: mol_type = other RNA
aggaactccggaaatcgcaggga

SEQ ID NO: 423 - RNA, 23 nt, synthetic construct
  source 1..23: mol_type = other RNA
gtgacactgcggaaggaactccg

SEQ ID NO: 424 - RNA, 23 nt, synthetic construct
  source 1..23: mol_type = other RNA
atccggagtgacactgcggaagg

SEQ ID NO: 425 - RNA, 23 nt, synthetic construct
  source 1..23: mol_type = other RNA
ggaatccggagtgacactgcgga

SEQ ID NO: 426 - RNA, 23 nt, synthetic construct
  source 1..23: mol_type = other RNA
cacctcctggtgggtaggcaggc

SEQ ID NO: 427 - RNA, 23 nt, synthetic construct
  source 1..23: mol_type = other RNA
gggcatatagtctccactgccct

SEQ ID NO: 428 - RNA, 23 nt, synthetic construct
  source 1..23: mol_type = other RNA
tcatgggcatatagtctccactg

SEQ ID NO: 429 - RNA, 23 nt, synthetic construct
  source 1..23: mol_type = other RNA
ggcgtctgatgggattgatgatc

SEQ ID NO: 430 - RNA, 23 nt, synthetic construct
  source 1..23: mol_type = other RNA
tggcgtctgatgggattgatgat

SEQ ID NO: 431 - RNA, 23 nt, synthetic construct
  source 1..23: mol_type = other RNA
tgtagtcacctgtgcaaggtaag

SEQ ID NO: 432 - RNA, 23 nt, synthetic construct
  source 1..23: mol_type = other RNA
tcatgtagtcacctgtgcaaggt

SEQ ID NO: 433 - RNA, 23 nt, synthetic construct
  source 1..23: mol_type = other RNA
gttcatgtagtcacctgtgcaag

SEQ ID NO: 434 - RNA, 23 nt, synthetic construct
  source 1..23: mol_type = other RNA
atgttcatgtagtcacctgtgca

SEQ ID NO: 435 - RNA, 23 nt, synthetic construct
  source 1..23: mol_type = other RNA
ggcgctgggtgtgcttaaaggat

SEQ ID NO: 436 - RNA, 23 nt, synthetic construct
  source 1..23: mol_type = other RNA
gggcgctgggtgtgcttaaagga

SEQ ID NO: 437 - RNA, 23 nt, synthetic construct
  source 1..23: mol_type = other RNA
atagagaaggcgaccagagctag

SEQ ID NO: 438 - RNA, 23 nt, synthetic construct
  source 1..23: mol_type = other RNA
cggctattggtctgagcagctgt

SEQ ID NO: 439 - RNA, 23 nt, synthetic construct
  source 1..23: mol_type = other RNA
gcggctattggtctgagcagctg

SEQ ID NO: 440 - RNA, 23 nt, synthetic construct
  source 1..23: mol_type = other RNA
tcactttggcactctggttgcgg

SEQ ID NO: 441 - RNA, 23 nt, synthetic construct
  source 1..23: mol_type = other RNA
ctgcacggatcactttggcactc

SEQ ID NO: 442 - RNA, 23 nt, synthetic construct
  source 1..23: mol_type = other RNA
gtgggtctgcacggatcactttg

SEQ ID NO: 443 - RNA, 23 nt, synthetic construct
  source 1..23: mol_type = other RNA
tctatgtagttaagaccattctc

SEQ ID NO: 444 - RNA, 23 nt, synthetic construct
  source 1..23: mol_type = other RNA
atcctcacttgagcggcgggtgg

SEQ ID NO: 445 - RNA, 23 nt, synthetic construct
  source 1..23: mol_type = other RNA
aatcctcacttgagcggcgggtg

SEQ ID NO: 446 - RNA, 23 nt, synthetic construct
  source 1..23: mol_type = other RNA
gcataggcgcttaaatcctcact

SEQ ID NO: 447 - RNA, 23 nt, synthetic construct
  source 1..23: mol_type = other RNA
tggcataggcgcttaaatcctca

SEQ ID NO: 448 - RNA, 23 nt, synthetic construct
  source 1..23: mol_type = other RNA
aggtcatttaggtcttcattctg

SEQ ID NO: 449 - RNA, 23 nt, synthetic construct
  source 1..23: mol_type = other RNA
ctgaggtcatttaggtcttcatt

SEQ ID NO: 450 - RNA, 23 nt, synthetic construct
  source 1..23: mol_type = other RNA
ggatttgctgaggtcatttaggt

SEQ ID NO: 451 - RNA, 23 nt, synthetic construct
  source 1..23: mol_type = other RNA
tcctagttgtgaatcatgaaata

SEQ ID NO: 452 - RNA, 23 nt, synthetic construct
  source 1..23: mol_type = other RNA
atatgaggtcctagttgtgaatc

SEQ ID NO: 453 - RNA, 23 nt, synthetic construct
  source 1..23: mol_type = other RNA
cgtaccatctactgatgaggaag

SEQ ID NO: 454 - RNA, 23 nt, synthetic construct
  source 1..23: mol_type = other RNA
atcgtaccatctactgatgagga

SEQ ID NO: 455 - RNA, 23 nt, synthetic construct
  source 1..23: mol_type = other RNA
gcatcgtaccatctactgatgag

SEQ ID NO: 456 - RNA, 23 nt, synthetic construct
  source 1..23: mol_type = other RNA
tgcatcgtaccatctactgatga

SEQ ID NO: 457 - RNA, 23 nt, synthetic construct
  source 1..23: mol_type = other RNA
atgcatcgtaccatctactgatg

SEQ ID NO: 458 - RNA, 21 nt, synthetic construct
  source 1..21: mol_type = other RNA
gcagcatggcgagccctccgg

SEQ ID NO: 459 - RNA, 21 nt, synthetic construct
  source 1..21: mol_type = other RNA
acgtgcgcaaggtgggctacc

SEQ ID NO: 460 - RNA, 21 nt, synthetic construct
  source 1..21: mol_type = other RNA
cgtgcgcaaggtgggctacct

SEQ ID NO: 461 - RNA, 21 nt, synthetic construct
  source 1..21: mol_type = other RNA
caagagcatgcacaaacgctt

SEQ ID NO: 462 - RNA, 21 nt, synthetic construct
  source 1..21: mol_type = other RNA
aagagcatgcacaaacgcttc

SEQ ID NO: 463 - RNA, 21 nt, synthetic construct
  source 1..21: mol_type = other RNA
catgcacaaacgcttcttcgt

SEQ ID NO: 464 - RNA, 21 nt, synthetic construct
  source 1..21: mol_type = other RNA
gcacaaacgcttcttcgtact

SEQ ID NO: 465 - RNA, 21 nt, synthetic construct
  source 1..21: mol_type = other RNA
acgagaagaagtggcggcaca

SEQ ID NO: 466 - RNA, 21 nt, synthetic construct
  source 1..21: mol_type = other RNA
gagaagaagtggcggcacaag

SEQ ID NO: 467 - RNA, 21 nt, synthetic construct
  source 1..21: mol_type = other RNA
agaagtggcggcacaagtcga

SEQ ID NO: 468 - RNA, 21 nt, synthetic construct
  source 1..21: mol_type = other RNA
gaagtggcggcacaagtcgag

SEQ ID NO: 469 - RNA, 21 nt, synthetic construct
  source 1..21: mol_type = other RNA
aagtggcggcacaagtcgagc

SEQ ID NO: 470 - RNA, 21 nt, synthetic construct
  source 1..21: mol_type = other RNA
gggctgactccaagaacaagc

SEQ ID NO: 471 - RNA, 21 nt, synthetic construct
  source 1..21: mol_type = other RNA
ggctgactccaagaacaagca

SEQ ID NO: 472 - RNA, 21 nt, synthetic construct
  source 1..21: mol_type = other RNA
gctgactccaagaacaagcac

SEQ ID NO: 473 - RNA, 21 nt, synthetic construct
  source 1..21: mol_type = other RNA
caagaacaagcacctggtggc

SEQ ID NO: 474 - RNA, 21 nt, synthetic construct
  source 1..21: mol_type = other RNA
acctggtggctctctacaccc

SEQ ID NO: 475 - RNA, 21 nt, synthetic construct
  source 1..21: mol_type = other RNA
tggtggctctctacacccggg

SEQ ID NO: 476 - RNA, 21 nt, synthetic construct
  source 1..21: mol_type = other RNA
ccgagcaagacagctggtacc

SEQ ID NO: 477 - RNA, 21 nt, synthetic construct
  source 1..21: mol_type = other RNA
ggacttgagctacggtgacgt

SEQ ID NO: 478 - RNA, 21 nt, synthetic construct
  source 1..21: mol_type = other RNA
cccaagggcctgggtcagaca

SEQ ID NO: 479 - RNA, 21 nt, synthetic construct
  source 1..21: mol_type = other RNA
ctgggtcagacaaagaacctg

SEQ ID NO: 480 - RNA, 21 nt, synthetic construct
  source 1..21: mol_type = other RNA
tgggtcagacaaagaacctga

SEQ ID NO: 481 - RNA, 21 nt, synthetic construct
  source 1..21: mol_type = other RNA
aacctgattggtatctaccgc

SEQ ID NO: 482 - RNA, 21 nt, synthetic construct
  source 1..21: mol_type = other RNA
cctgattggtatctaccgcct

SEQ ID NO: 483 - RNA, 21 nt, synthetic construct
  source 1..21: mol_type = other RNA
gaccagcaagaccatcagctt

SEQ ID NO: 484 - RNA, 21 nt, synthetic construct
  source 1..21: mol_type = other RNA
tcatcgaggtgggccgttctg

SEQ ID NO: 485 - RNA, 21 nt, synthetic construct
  source 1..21: mol_type = other RNA
gagttccgccctcgcagcaag

SEQ ID NO: 486 - RNA, 21 nt, synthetic construct
  source 1..21: mol_type = other RNA
acggcgaaggcaccatgtccc

SEQ ID NO: 487 - RNA, 21 nt, synthetic construct
  source 1..21: mol_type = other RNA
cgctcaaccacagccgctcca

SEQ ID NO: 488 - RNA, 21 nt, synthetic construct
  source 1..21: mol_type = other RNA
ctccacctcggattgtctctt

SEQ ID NO: 489 - RNA, 21 nt, synthetic construct
  source 1..21: mol_type = other RNA
tgtctcttcccacggcgatct

SEQ ID NO: 490 - RNA, 21 nt, synthetic construct
  source 1..21: mol_type = other RNA
ttcccacggcgatctagtgct

SEQ ID NO: 491 - RNA, 21 nt, synthetic construct
  source 1..21: mol_type = other RNA
cagcgatggcggtttcatctc

SEQ ID NO: 492 - RNA, 21 nt, synthetic construct
  source 1..21: mol_type = other RNA
ccagtccctgcgatttccgga

SEQ ID NO: 493 - RNA, 21 nt, synthetic construct
  source 1..21: mol_type = other RNA
agtccctgcgatttccggagt

SEQ ID NO: 494 - RNA, 21 nt, synthetic construct
  source 1..21: mol_type = other RNA
gtccctgcgatttccggagtt

SEQ ID NO: 495 - RNA, 21 nt, synthetic construct
  source 1..21: mol_type = other RNA
cctgcgatttccggagttcct

SEQ ID NO: 496 - RNA, 21 nt, synthetic construct
  source 1..21: mol_type = other RNA
gagttccttccgcagtgtcac

SEQ ID NO: 497 - RNA, 21 nt, synthetic construct
  source 1..21: mol_type = other RNA
ttccgcagtgtcactccggat

SEQ ID NO: 498 - RNA, 21 nt, synthetic construct
  source 1..21: mol_type = other RNA
cgcagtgtcactccggattcc

SEQ ID NO: 499 - RNA, 21 nt, synthetic construct
  source 1..21: mol_type = other RNA
ctgcctacccaccaggaggtg

SEQ ID NO: 500 - RNA, 21 nt, synthetic construct
  source 1..21: mol_type = other RNA
ggcagtggagactatatgccc

SEQ ID NO: 501 - RNA, 21 nt, synthetic construct
  source 1..21: mol_type = other RNA
gtggagactatatgcccatga

SEQ ID NO: 502 - RNA, 21 nt, synthetic construct
  source 1..21: mol_type = other RNA
tcatcaatcccatcagacgcc

SEQ ID NO: 503 - RNA, 21 nt, synthetic construct
  source 1..21: mol_type = other RNA
catcaatcccatcagacgcca

SEQ ID NO: 504 - RNA, 21 nt, synthetic construct
  source 1..21: mol_type = other RNA
taccttgcacaggtgactaca

SEQ ID NO: 505 - RNA, 21 nt, synthetic construct
  source 1..21: mol_type = other RNA
cttgcacaggtgactacatga

SEQ ID NO: 506 - RNA, 21 nt, synthetic construct
  source 1..21: mol_type = other RNA
tgcacaggtgactacatgaac

SEQ ID NO: 507 - RNA, 21 nt, synthetic construct
  source 1..21: mol_type = other RNA
cacaggtgactacatgaacat

SEQ ID NO: 508 - RNA, 21 nt, synthetic construct
  source 1..21: mol_type = other RNA
cctttaagcacacccagcgcc

SEQ ID NO: 509 - RNA, 21 nt, synthetic construct
  source 1..21: mol_type = other RNA
ctttaagcacacccagcgccc

SEQ ID NO: 510 - RNA, 21 nt, synthetic construct
  source 1..21: mol_type = other RNA
agctctggtcgccttctctat

SEQ ID NO: 511 - RNA, 21 nt, synthetic construct
  source 1..21: mol_type = other RNA
agctgctcagaccaatagccg

SEQ ID NO: 512 - RNA, 21 nt, synthetic construct
  source 1..21: mol_type = other RNA
gctgctcagaccaatagccgc

SEQ ID NO: 513 - RNA, 21 nt, synthetic construct
  source 1..21: mol_type = other RNA
gcaaccagagtgccaaagtga

SEQ ID NO: 514 - RNA, 21 nt, synthetic construct
  source 1..21: mol_type = other RNA
gtgccaaagtgatccgtgcag

SEQ ID NO: 515 - RNA, 21 nt, synthetic construct
  source 1..21: mol_type = other RNA
aagtgatccgtgcagacccac

SEQ ID NO: 516 - RNA, 21 nt, synthetic construct
  source 1..21: mol_type = other RNA
gaatggtcttaactacataga

SEQ ID NO: 517 - RNA, 21 nt, synthetic construct
  source 1..21: mol_type = other RNA
acccgccgctcaagtgaggat

SEQ ID NO: 518 - RNA, 21 nt, synthetic construct
  source 1..21: mol_type = other RNA
cccgccgctcaagtgaggatt

SEQ ID NO: 519 - RNA, 21 nt, synthetic construct
  source 1..21: mol_type = other RNA
tgaggatttaagcgcctatgc

SEQ ID NO: 520 - RNA, 21 nt, synthetic construct
  source 1..21: mol_type = other RNA
aggatttaagcgcctatgcca

SEQ ID NO: 521 - RNA, 21 nt, synthetic construct
  source 1..21: mol_type = other RNA
gaatgaagacctaaatgacct

SEQ ID NO: 522 - RNA, 21 nt, synthetic construct
  source 1..21: mol_type = other RNA
tgaagacctaaatgacctcag

SEQ ID NO: 523 - RNA, 21 nt, synthetic construct
  source 1..21: mol_type = other RNA
ctaaatgacctcagcaaatcc

SEQ ID NO: 524 - RNA, 21 nt, synthetic construct
  source 1..21: mol_type = other RNA
tttcatgattcacaactagga

SEQ ID NO: 525 - RNA, 21 nt, synthetic construct
  source 1..21: mol_type = other RNA
ttcacaactaggacctcatat

SEQ ID NO: 526 - RNA, 21 nt, synthetic construct
  source 1..21: mol_type = other RNA
tcctcatcagtagatggtacg

SEQ ID NO: 527 - RNA, 21 nt, synthetic construct
  source 1..21: mol_type = other RNA
ctcatcagtagatggtacgat

SEQ ID NO: 528 - RNA, 21 nt, synthetic construct
  source 1..21: mol_type = other RNA
catcagtagatggtacgatgc

SEQ ID NO: 529 - RNA, 21 nt, synthetic construct
  source 1..21: mol_type = other RNA
atcagtagatggtacgatgca

SEQ ID NO: 530 - RNA, 21 nt, synthetic construct
  source 1..21: mol_type = other RNA
tcagtagatggtacgatgcat

SEQ ID NO: 531 - RNA, 23 nt, synthetic construct
  modified_base 1: mod_base = OTHER; note = 2'-O-methylcytidine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ccggagggctcgccatgctgcca

SEQ ID NO: 532 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ggtagcccaccttgcgcacgtcc

SEQ ID NO: 533 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aggtagcccaccttgcgcacgtc

SEQ ID NO: 534 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aagcgtttgtgcatgctcttggg

SEQ ID NO: 535 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gaagcgtttgtgcatgctcttgg

SEQ ID NO: 536 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
acgaagaagcgtttgtgcatgct

SEQ ID NO: 537 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
agtacgaagaagcgtttgtgcat

SEQ ID NO: 538 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgtgccgccacttcttctcgttc

SEQ ID NO: 539 - RNA, 23 nt, synthetic construct
  modified_base 1: mod_base = OTHER; note = 2'-O-methylcytidine-3'-phosphorothioate
  modified_base 2: mod_base = OTHER; note = 2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
cttgtgccgccacttcttctcgt

SEQ ID NO: 540 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcgacttgtgccgccacttcttc

SEQ ID NO: 541 - RNA, 23 nt, synthetic construct
  modified_base 1: mod_base = OTHER; note = 2'-O-methylcytidine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ctcgacttgtgccgccacttctt

SEQ ID NO: 542 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gctcgacttgtgccgccacttct

SEQ ID NO: 543 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gcttgttcttggagtcagcccgc

SEQ ID NO: 544 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgcttgttcttggagtcagcccg

SEQ ID NO: 545 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gtgcttgttcttggagtcagccc

SEQ ID NO: 546 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gccaccaggtgcttgttcttgga

SEQ ID NO: 547 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gggtgtagagagccaccaggtgc

SEQ ID NO: 548 - RNA, 23 nt, synthetic construct
  modified_base 1: mod_base = OTHER; note = 2'-O-methylcytidine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
cccgggtgtagagagccaccagg

SEQ ID NO: 549 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ggtaccagctgtcttgctcggcc

SEQ ID NO: 550 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
acgtcaccgtagctcaagtcctc

SEQ ID NO: 551 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgtctgacccaggcccttgggct

SEQ ID NO: 552 - RNA, 23 nt, synthetic construct
  modified_base 1: mod_base = OTHER; note = 2'-O-methylcytidine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
caggttctttgtctgacccaggc

SEQ ID NO: 553 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcaggttctttgtctgacccagg

SEQ ID NO: 554 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gcggtagataccaatcaggttct

SEQ ID NO: 555 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aggcggtagataccaatcaggtt

SEQ ID NO: 556 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aagctgatggtcttgctggtcag

SEQ ID NO: 557 - RNA, 23 nt, synthetic construct
  modified_base 1: mod_base = OTHER; note = 2'-O-methylcytidine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
cagaacggcccacctcgatgaag

SEQ ID NO: 558 - RNA, 23 nt, synthetic construct
  modified_base 1: mod_base = OTHER; note = 2'-O-methylcytidine-3'-phosphorothioate
  modified_base 2: mod_base = OTHER; note = 2'-fluorouridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
cttgctgcgagggcggaactcat

SEQ ID NO: 559 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gggacatggtgccttcgccgtca

SEQ ID NO: 560 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tggagcggctgtggttgagcggg

SEQ ID NO: 561 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aagagacaatccgaggtggagcc

SEQ ID NO: 562 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
agatcgccgtgggaagagacaat

SEQ ID NO: 563 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
agcactagatcgccgtgggaaga

SEQ ID NO: 564 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gagatgaaaccgccatcgctggg

SEQ ID NO: 565 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tccggaaatcgcagggactggag

SEQ ID NO: 566 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
actccggaaatcgcagggactgg

SEQ ID NO: 567 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroadenosine-3'-phosporothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aactccggaaatcgcagggactg

SEQ ID NO: 568 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aggaactccggaaatcgcaggga

SEQ ID NO: 569 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gtgacactgcggaaggaactccg

SEQ ID NO: 570 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
atccggagtgacactgcggaagg

SEQ ID NO: 571 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ggaatccggagtgacactgcgga

SEQ ID NO: 572 - RNA, 23 nt, synthetic construct
  modified_base 1: mod_base = OTHER; note = 2'-O-methylcytidine-3'-phosphorothioate
  modified_base 2: mod_base = OTHER; note = 2'-fluoroadenosine-3'-phosporothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
cacctcctggtgggtaggcaggc

SEQ ID NO: 573 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gggcatatagtctccactgccct

SEQ ID NO: 574 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcatgggcatatagtctccactg

SEQ ID NO: 575 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ggcgtctgatgggattgatgatc

SEQ ID NO: 576 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tggcgtctgatgggattgatgat

SEQ ID NO: 577 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgtagtcacctgtgcaaggtaag

SEQ ID NO: 578 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcatgtagtcacctgtgcaaggt

SEQ ID NO: 579 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorouridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gttcatgtagtcacctgtgcaag

SEQ ID NO: 580 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
atgttcatgtagtcacctgtgca

SEQ ID NO: 581 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ggcgctgggtgtgcttaaaggat

SEQ ID NO: 582 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gggcgctgggtgtgcttaaagga

SEQ ID NO: 583 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorouridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
atagagaaggcgaccagagctag

SEQ ID NO: 584 - RNA, 23 nt, synthetic construct
  modified_base 1: mod_base = OTHER; note = 2'-O-methylcytidine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
cggctattggtctgagcagctgt

SEQ ID NO: 585 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gcggctattggtctgagcagctg

SEQ ID NO: 586 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcactttggcactctggttgcgg

SEQ ID NO: 587 - RNA, 23 nt, synthetic construct
  modified_base 1: mod_base = OTHER; note = 2'-O-methylcytidine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ctgcacggatcactttggcactc

SEQ ID NO: 588 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gtgggtctgcacggatcactttg

SEQ ID NO: 589 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tctatgtagttaagaccattctc

SEQ ID NO: 590 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
atcctcacttgagcggcgggtgg

SEQ ID NO: 591 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroadenosine-3'-phosporothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aatcctcacttgagcggcgggtg

SEQ ID NO: 592 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gcataggcgcttaaatcctcact

SEQ ID NO: 593 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tggcataggcgcttaaatcctca

SEQ ID NO: 594 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aggtcatttaggtcttcattctg

SEQ ID NO: 595 - RNA, 23 nt, synthetic construct
  modified_base 1: mod_base = OTHER; note = 2'-O-methylcytidine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ctgaggtcatttaggtcttcatt

SEQ ID NO: 596 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ggatttgctgaggtcatttaggt

SEQ ID NO: 597 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tcctagttgtgaatcatgaaata

SEQ ID NO: 598 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorouridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
atatgaggtcctagttgtgaatc

SEQ ID NO: 599 - RNA, 23 nt, synthetic construct
  modified_base 1: mod_base = OTHER; note = 2'-O-methylcytidine-3'-phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
cgtaccatctactgatgaggaag

SEQ ID NO: 600 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
atcgtaccatctactgatgagga

SEQ ID NO: 601 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gcatcgtaccatctactgatgag

SEQ ID NO: 602 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tgcatcgtaccatctactgatga

SEQ ID NO: 603 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
atgcatcgtaccatctactgatg

SEQ ID NO: 604 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcagcatggcgagccctccgg

SEQ ID NO: 605 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
acgtgcgcaaggtgggctacc

SEQ ID NO: 606 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cgtgcgcaaggtgggctacct

SEQ ID NO: 607 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
caagagcatgcacaaacgctt

SEQ ID NO: 608 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aagagcatgcacaaacgcttc

SEQ ID NO: 609 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
catgcacaaacgcttcttcgt

SEQ ID NO: 610 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcacaaacgcttcttcgtact

SEQ ID NO: 611 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
acgagaagaagtggcggcaca

SEQ ID NO: 612 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gagaagaagtggcggcacaag

SEQ ID NO: 613 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agaagtggcggcacaagtcga

SEQ ID NO: 614 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gaagtggcggcacaagtcgag

SEQ ID NO: 615 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aagtggcggcacaagtcgagc

SEQ ID NO: 616 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gggctgactccaagaacaagc

SEQ ID NO: 617 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggctgactccaagaacaagca

SEQ ID NO: 618 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gctgactccaagaacaagcac

SEQ ID NO: 619 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
caagaacaagcacctggtggc

SEQ ID NO: 620 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
acctggtggctctctacaccc

SEQ ID NO: 621 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tggtggctctctacacccggg

SEQ ID NO: 622 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ccgagcaagacagctggtacc

SEQ ID NO: 623 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggacttgagctacggtgacgt

SEQ ID NO: 624 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cccaagggcctgggtcagaca

SEQ ID NO: 625 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctgggtcagacaaagaacctg

SEQ ID NO: 626 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tgggtcagacaaagaacctga

SEQ ID NO: 627 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aacctgattggtatctaccgc

SEQ ID NO: 628 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cctgattggtatctaccgcct

SEQ ID NO: 629 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gaccagcaagaccatcagctt

SEQ ID NO: 630 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tcatcgaggtgggccgttctg

SEQ ID NO: 631 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gagttccgccctcgcagcaag

SEQ ID NO: 632 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
acggcgaaggcaccatgtccc

SEQ ID NO: 633 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cgctcaaccacagccgctcca

SEQ ID NO: 634 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctccacctcggattgtctctt

SEQ ID NO: 635 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tgtctcttcccacggcgatct

SEQ ID NO: 636 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ttcccacggcgatctagtgct

SEQ ID NO: 637 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cagcgatggcggtttcatctc

SEQ ID NO: 638 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ccagtccctgcgatttccgga

SEQ ID NO: 639 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agtccctgcgatttccggagt

SEQ ID NO: 640 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gtccctgcgatttccggagtt

SEQ ID NO: 641 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cctgcgatttccggagttcct

SEQ ID NO: 642 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gagttccttccgcagtgtcac

SEQ ID NO: 643 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ttccgcagtgtcactccggat

SEQ ID NO: 644 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cgcagtgtcactccggattcc

SEQ ID NO: 645 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctgcctacccaccaggaggtg

SEQ ID NO: 646 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ggcagtggagactatatgccc

SEQ ID NO: 647 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gtggagactatatgcccatga

SEQ ID NO: 648 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tcatcaatcccatcagacgcc

SEQ ID NO: 649 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
catcaatcccatcagacgcca

SEQ ID NO: 650 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
taccttgcacaggtgactaca

SEQ ID NO: 651 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cttgcacaggtgactacatga

SEQ ID NO: 652 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyladenosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tgcacaggtgactacatgaac

SEQ ID NO: 653 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cacaggtgactacatgaacat

SEQ ID NO: 654 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cctttaagcacacccagcgcc

SEQ ID NO: 655 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctttaagcacacccagcgccc

SEQ ID NO: 656 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agctctggtcgccttctctat

SEQ ID NO: 657 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agctgctcagaccaatagccg

SEQ ID NO: 658 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methylguanosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gctgctcagaccaatagccgc

SEQ ID NO: 659 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcaaccagagtgccaaagtga

SEQ ID NO: 660 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gtgccaaagtgatccgtgcag

SEQ ID NO: 661 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyladenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aagtgatccgtgcagacccac

SEQ ID NO: 662 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gaatggtcttaactacataga

SEQ ID NO: 663 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
acccgccgctcaagtgaggat

SEQ ID NO: 664 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methyluridine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cccgccgctcaagtgaggatt

SEQ ID NO: 665 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tgaggatttaagcgcctatgc

SEQ ID NO: 666 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
aggatttaagcgcctatgcca

SEQ ID NO: 667 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gaatgaagacctaaatgacct

SEQ ID NO: 668 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tgaagacctaaatgacctcag

SEQ ID NO: 669 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctaaatgacctcagcaaatcc

SEQ ID NO: 670 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tttcatgattcacaactagga

SEQ ID NO: 671 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methyladenosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ttcacaactaggacctcatat

SEQ ID NO: 672 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylcytidine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tcctcatcagtagatggtacg

SEQ ID NO: 673 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctcatcagtagatggtacgat

SEQ ID NO: 674 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
catcagtagatggtacgatgc

SEQ ID NO: 675 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphorothioate
  modified_base 20: mod_base = OTHER; note = 2'-O-methylcytidine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
atcagtagatggtacgatgca

SEQ ID NO: 676 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tcagtagatggtacgatgcat

SEQ ID NO: 677 - RNA, 23 nt, synthetic construct
  source 1..23: mol_type = other RNA
gaacgtgcagttcagtcaatgaa

SEQ ID NO: 678 - RNA, 23 nt, synthetic construct
  source 1..23: mol_type = other RNA
agaacgtgcagttcagtcaatga

SEQ ID NO: 679 - RNA, 23 nt, synthetic construct
  source 1..23: mol_type = other RNA
tagaacgtgcagttcagtcaatg

SEQ ID NO: 680 - RNA, 23 nt, synthetic construct
  source 1..23: mol_type = other RNA
gcacaatatagaacgtgcagttc

SEQ ID NO: 681 - RNA, 23 nt, synthetic construct
  source 1..23: mol_type = other RNA
tctcatgacacggtggtgggcac

SEQ ID NO: 682 - RNA, 23 nt, synthetic construct
  source 1..23: mol_type = other RNA
ctctcatgacacggtggtgggca

SEQ ID NO: 683 - RNA, 23 nt, synthetic construct
  source 1..23: mol_type = other RNA
aggatcataccctattctactct

SEQ ID NO: 684 - RNA, 23 nt, synthetic construct
  source 1..23: mol_type = other RNA
atggcactatgattcttatatta

SEQ ID NO: 685 - RNA, 23 nt, synthetic construct
  source 1..23: mol_type = other RNA
tctatggcactatgattcttata

SEQ ID NO: 686 - RNA, 23 nt, synthetic construct
  source 1..23: mol_type = other RNA
agagatagtatcagcaaatataa

SEQ ID NO: 687 - RNA, 23 nt, synthetic construct
  source 1..23: mol_type = other RNA
caagagatagtatcagcaaatat

SEQ ID NO: 688 - RNA, 23 nt, synthetic construct
  source 1..23: mol_type = other RNA
agatcaacagtatctagtttatt

SEQ ID NO: 689 - RNA, 21 nt, synthetic construct
  source 1..21: mol_type = other RNA
cattgactgaactgcacgttc

SEQ ID NO: 690 - RNA, 21 nt, synthetic construct
  source 1..21: mol_type = other RNA
attgactgaactgcacgttct

SEQ ID NO: 691 - RNA, 21 nt, synthetic construct
  source 1..21: mol_type = other RNA
ttgactgaactgcacgttcta

SEQ ID NO: 692 - RNA, 21 nt, synthetic construct
  source 1..21: mol_type = other RNA
actgcacgttctatattgtgc

SEQ ID NO: 693 - RNA, 21 nt, synthetic construct
  source 1..21: mol_type = other RNA
gcccaccaccgtgtcatgaga

SEQ ID NO: 694 - RNA, 21 nt, synthetic construct
  source 1..21: mol_type = other RNA
cccaccaccgtgtcatgagag

SEQ ID NO: 695 - RNA, 21 nt, synthetic construct
  source 1..21: mol_type = other RNA
agtagaatagggtatgatcct

SEQ ID NO: 696 - RNA, 21 nt, synthetic construct
  source 1..21: mol_type = other RNA
atataagaatcatagtgccat

SEQ ID NO: 697 - RNA, 21 nt, synthetic construct
  source 1..21: mol_type = other RNA
taagaatcatagtgccataga

SEQ ID NO: 698 - RNA, 21 nt, synthetic construct
  source 1..21: mol_type = other RNA
atatttgctgatactatctct

SEQ ID NO: 699 - RNA, 21 nt, synthetic construct
  source 1..21: mol_type = other RNA
atttgctgatactatctcttg

SEQ ID NO: 700 - RNA, 21 nt, synthetic construct
  source 1..21: mol_type = other RNA
taaactagatactgttgatct

SEQ ID NO: 701 - RNA, 23 nt, synthetic construct
  modified_base 1: mod_base = OTHER; note = 2'-O-methylguanosine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gaacgtgcagttcagtcaatgaa

SEQ ID NO: 702 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
agaacgtgcagttcagtcaatga

SEQ ID NO: 703 - RNA, 23 nt, synthetic construct
  modified_base 1: mod_base = OTHER; note = 2'-O-methyluridine-3'-phosphorothioate
  modified_base 2: mod_base = OTHER; note = 2'-fluoroadenosine-3'-phosporothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tagaacgtgcagttcagtcaatg

SEQ ID NO: 704 - RNA, 23 nt, synthetic construct
  modified_base 1: mod_base = OTHER; note = 2'-O-methylguanosine-3'-phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
gcacaatatagaacgtgcagttc

SEQ ID NO: 705 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphorothioate
  modified_base 22: mod_base = OTHER; note = 2'-O-methyladenosine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tctcatgacacggtggtgggcac

SEQ ID NO: 706 - RNA, 23 nt, synthetic construct
  modified_base 1: mod_base = OTHER; note = 2'-O-methylcytidine-3'-phosphorothioate
  modified_base 2: mod_base = OTHER; note = 2'-fluorouridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'-phosphorothioate
  modified_base 22: mod_base = OTHER; note = 2'-O-methylcytidine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
ctctcatgacacggtggtgggca

SEQ ID NO: 707 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
aggatcataccctattctactct

SEQ ID NO: 708 - RNA, 23 nt, synthetic construct
  modified_base 1: mod_base = OTHER; note = 2'-O-methyladenosine-3'-phosphorothioate
  modified_base 2: mod_base = OTHER; note = 2'-fluorouridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
atggcactatgattcttatatta

SEQ ID NO: 709 - RNA, 23 nt, synthetic construct
  modified_base 1: mod_base = OTHER; note = 2'-O-methyluridine-3'-phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
tctatggcactatgattcttata

SEQ ID NO: 710 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
agagatagtatcagcaaatataa

SEQ ID NO: 711 - RNA, 23 nt, synthetic construct
  modified_base 1: mod_base = OTHER; note = 2'-O-methylcytidine-3'-phosphorothioate
  modified_base 2: mod_base = OTHER; note = 2'-fluoroadenosine-3'-phosporothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
caagagatagtatcagcaaatat

SEQ ID NO: 712 - RNA, 23 nt, synthetic construct
  modified_base 1: mod_base = OTHER; note = 2'-O-methyladenosine-3'-phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3: note = RNA
  misc_feature 4: note = RNA
  misc_feature 5: note = RNA
  misc_feature 6: note = DNA
  misc_feature 7: note = RNA
  misc_feature 8: note = RNA
  misc_feature 9: note = RNA
  misc_feature 10: note = RNA
  misc_feature 11: note = RNA
  misc_feature 12: note = RNA
  misc_feature 13: note = RNA
  misc_feature 14: note = DNA
  misc_feature 15: note = RNA
  misc_feature 16: note = DNA
  misc_feature 17: note = RNA
  misc_feature 18: note = RNA
  misc_feature 19: note = RNA
  misc_feature 20: note = RNA
  misc_feature 21: note = RNA
  misc_feature 22: note = RNA
  misc_feature 23: note = RNA
  source 1..23: mol_type = other RNA
agatcaacagtatctagtttatt

SEQ ID NO: 713 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cattgactgaactgcacgttc

SEQ ID NO: 714 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
attgactgaactgcacgttct

SEQ ID NO: 715 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methyluridine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ttgactgaactgcacgttcta

SEQ ID NO: 716 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphorothioate
  modified_base 20: mod_base = OTHER; note = 2'-O-methylguanosine-3'-phosphorothioate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
actgcacgttctatattgtgc

SEQ ID NO: 717 - RNA, 21 nt, synthetic construct
  modified_base 1: mod_base = OTHER; note = 2'-O-methylguanosine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
gcccaccaccgtgtcatgaga

SEQ ID NO: 718 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methylcytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphorothioate
  modified_base 20: mod_base = OTHER; note = 2'-O-methyladenosine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cccaccaccgtgtcatgagag

SEQ ID NO: 719 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
agtagaatagggtatgatcct

SEQ ID NO: 720 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphorothioate
  modified_base 20: mod_base = OTHER; note = 2'-O-methyladenosine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
atataagaatcatagtgccat

SEQ ID NO: 721 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphorothioate
  modified_base 20: mod_base = OTHER; note = 2'-O-methylguanosine-3'-phosphorothioate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
taagaatcatagtgccataga

SEQ ID NO: 722 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
atatttgctgatactatctct

SEQ ID NO: 723 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphorothioate
  modified_base 20: mod_base = OTHER; note = 2'-O-methyluridine-3'-phosphorothioate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
atttgctgatactatctcttg

SEQ ID NO: 724 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyladenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphorothioate
  modified_base 20: mod_base = OTHER; note = 2'-O-methylcytidine-3'-phosphorothioate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
taaactagatactgttgatct

SEQ ID NO: 725 - RNA, 9771 nt, synthetic construct
  source 1..9771: mol_type = other RNA
ggcggctgcccggctgccgagcgcggaggctccgtcacgtgtttttctcctccgagtgagacggcggcgcggtcggagggggccggcgcgcagagccagacgccgccgcttgttttggttggggctctcggcaactctccgaggaggaggaggaggagggaggaggggagaagtaactgcagcggcagcgcctcccgaggaacaggcgtcttccccgaacccttcccaaacctcccccatcccctctcgcccttgtcccctcccctcctccccagccgcctggagcgaggggcagggatgagtctgtccctccggccggtccccagctgcagtggctgcccggtatcgtttcgcatggaaaagccactttctccacccgccgagatgggcccggatgggggctgcagaggacgcgcccgcgggcggcggcagcagcagcagcagcagcagcagcaacagcaacagccgcagcgccgcggtctctgcgactgagctggtatttgggcggctggtggcggctgggacggttggggggtgggaggaggcgaaggaggagggagaaccccgtgcaacgttgggacttggcaacccgcctccccctgcccaaggatatttaatttgcctcgggaatcgctgcttccagaggggaactcaggagggaaggcgcgcgcgcgcgcgcgctcctggaggggcaccgcagggacccccgactgtcgcctccctgtgccggactccagccggggcgacgagagatgcatcttcgctccttcctggtggcggcggcggctgagaggagacttggctctcggaggatcggggctgccctcaccccggacgcactgcctccccgccgggcgtgaagcgcccgaaaactccggtcgggctctctcctgggctcagcagctgcgtcctccttcagctgcccctccccggcgcggggggcggcgtggatttcagagtcggggtttctgctgcctccagccctgtttgcatgtgccgggccgcggcgaggagcctccgccccccacccggttgtttttcggagcctccctctgctcagcgttggtggtggcggtggcagcatggcgagccctccggagagcgatggcttctcggacgtgcgcaaggtgggctacctgcgcaaacccaagagcatgcacaaacgcttcttcgtactgcgcgcggccagcgaggctgggggcccggcgcgcctcgagtactacgagaacgagaagaagtggcggcacaagtcgagcgcccccaaacgctcgatcccccttgagagctgcttcaacatcaacaagcgggctgactccaagaacaagcacctggtggctctctacacccgggacgagcactttgccatcgcggcggacagcgaggccgagcaagacagctggtaccaggctctcctacagctgcacaaccgtgctaagggccaccacgacggagctgcggccctcggggcgggaggtggtgggggcagctgcagcggcagctccggccttggtgaggctggggaggacttgagctacggtgacgtgcccccaggacccgcattcaaagaggtctggcaagtgatcctgaagcccaagggcctgggtcagacaaagaacctgattggtatctaccgcctttgcctgaccagcaagaccatcagcttcgtgaagctgaactcggaggcagcggccgtggtgctgcagctgatgaacatcaggcgctgtggccactcggaaaacttcttcttcatcgaggtgggccgttctgccgtgacggggcccggggagttctggatgcaggtggatgactctgtggtggcccagaacatgcacgagaccatcctggaggccatgcgggccatgagtgatgagttccgccctcgcagcaagagccagtcctcgtccaactgctctaaccccatcagcgtccccctgcgccggcaccatctcaacaatcccccgcccagccaggtggggctgacccgccgatcacgcactgagagcatcaccgccacctccccggccagcatggtgggcgggaagccaggctccttccgtgtccgcgcctccagtgacggcgaaggcaccatgtcccgcccagcctcggtggacggcagccctgtgagtcccagcaccaacagaacccacgcccaccggcatcggggcagcgcccggctgcaccccccgctcaaccacagccgctccatccccatgccggcttcccgctgctcgccttcggccaccagcccggtcagtctgtcgtccagtagcaccagtggccatggctccacctcggattgtctcttcccacggcgatctagtgcttcggtgtctggttcccccagcgatggcggtttcatctcctcggatgagtatggctccagtccctgcgatttccggagttccttccgcagtgtcactccggattccctgggccacaccccaccagcccgcggtgaggaggagctaagcaactatatctgcatgggtggcaaggggccctccaccctgaccgcccccaacggtcactacattttgtctcggggtggcaatggccaccgctgcaccccaggaacaggcttgggcacgagtccagccttggctggggatgaagcagccagtgctgcagatctggataatcggttccgaaagagaactcactcggcaggcacatcccctaccattacccaccagaagaccccgtcccagtcctcagtggcttccattgaggagtacacagagatgatgcctgcctacccaccaggaggtggcagtggaggccgactgccgggacacaggcactccgccttcgtgcccacccgctcctacccagaggagggtctggaaatgcaccccttggagcgtcggggggggcaccaccgcccagacagctccaccctccacacggatgatggctacatgcccatgtccccaggggtggccccagtgcccagtggccgaaagggcagtggagactatatgcccatgagccccaagagcgtatctgccccacagcagatcatcaatcccatcagacgccatccccagagagtggaccccaatggctacatgatgatgtcccccagcggtggctgctctcctgacattggaggtggccccagcagcagcagcagcagcagcaacgccgtcccttccgggaccagctatggaaagctgtggacaaacggggtagggggccaccactctcatgtcttgcctcaccccaaacccccagtggagagcagcggtggtaagctcttaccttgcacaggtgactacatgaacatgtcaccagtgggggactccaacaccagcagcccctccgactgctactacggccctgaggacccccagcacaagccagtcctctcctactactcattgccaagatcctttaagcacacccagcgccccggggagccggaggagggtgcccggcatcagcacctccgcctttccactagctctggtcgccttctctatgctgcaacagcagatgattcttcctcttccaccagcagcgacagcctgggtgggggatactgcggggctaggctggagcccagccttccacatccccaccatcaggttctgcagccccatctgcctcgaaaggtggacacagctgctcagaccaatagccgcctggcccggcccacgaggctgtccctgggggatcccaaggccagcaccttacctcgggcccgagagcagcagcagcagcagcagcccttgctgcaccctccagagcccaagagcccgggggaatatgtcaatattgaatttgggagtgatcagtctggctacttgtctggcccggtggctttccacagctcaccttctgtcaggtgtccatcccagctccagccagctcccagagaggaagagactggcactgaggagtacatgaagatggacctggggccgggccggagggcagcctggcaggagagcactggggtcgagatgggcagactgggccctgcacctcccggggctgctagcatttgcaggcctacccgggcagtgcccagcagccggggtgactacatgaccatgcagatgagttgtccccgtcagagctacgtggacacctcgccagctgcccctgtaagctatgctgacatgcgaacaggcattgctgcagaggaggtgagcctgcccagggccaccatggctgctgcctcctcatcctcagcagcctctgcttccccgactgggcctcaaggggcagcagagctggctgcccactcgtccctgctggggggcccacaaggacctgggggcatgagcgccttcacccgggtgaacctcagtcctaaccgcaaccagagtgccaaagtgatccgtgcagacccacaagggtgccggcggaggcatagctccgagactttctcctcaacacccagtgccacccgggtgggcaacacagtgccctttggagcgggggcagcagtagggggcggtggcggtagcagcagcagcagcgaggatgtgaaacgccacagctctgcttcctttgagaatgtgtggctgaggcctggggagcttgggggagcccccaaggagccagccaaactgtgtggggctgctgggggtttggagaatggtcttaactacatagacctggatttggtcaaggacttcaaacagtgccctcaggagtgcacccctgaaccgcagcctcccccacccccaccccctcatcaacccctgggcagcggtgagagcagctccacccgccgctcaagtgaggatttaagcgcctatgccagcatcagtttccagaagcagccagaggaccgtcagtagctcaactggacatcacagcagaatgaagacctaaatgacctcagcaaatcctcttctaactcatgggtacccagactctaaatatttcatgattcacaactaggacctcatatcttcctcatcagtagatggtacgatgcatccatttcagtttgtttactttatccaatcctcaggatttcattgactgaactgcacgttctatattgtgccaagcgaaaaaaaaaaatgcactgtgacaccagaataatgagtctgcataaacttcatcttcaaccttaaggacttagctggccacagtgagctgatgtgcccaccaccgtgtcatgagagaatgggtttactctcaatgcattttcaagatacatttcatctgctgctgaaactgtgtacgacaaagcatcattgtaaattatttcatacaaaactgttcacgttgggtggagagagtattaaatatttaacataggttttgatttatatgtgtaattttttaaatgaaaatgtaacttttcttacagcacatcttttttttggatgtgggatggaggtatacaatgttctgttgtaaagagtggagcaaatgcttaaaacaaggcttaaaagagtagaatagggtatgatccttgttttaagattgtaattcagaaaacataatataagaatcatagtgccatagatggttctcaattgtatagttatatttgctgatactatctcttgtcatataaacctgatgttgagctgagttccttataagaattaatcttaattttgtattttttcctgtaagacaataggccatgttaattaaactgaagaaggatatatttggctgggtgttttcaaatgtcagcttaaaattggtaattgaatggaagcaaaattataagaagaggaaattaaagtcttccattgcatgtattgtaaacagaaggagatgggtgattccttcaattcaaaagctctctttggaatgaacaatgtgggcgtttgtaaattctggaaatgtctttctattcataataaactagatactgttgatcttttcttctgtcccctccccccaccacttctgtaagtttcctgctctattcccaccatttttttctgtgcacacattatgatatatttcatttcctgcattgtcttgagaaagatggtaaggcaagtgagctgttgctaaccagaaattaaaattccagtaagtgtttttcattatgaccagggctatgtgtcaccttccctaagactcttaccttatctcatattttttgagaacttccagtgttacattatttaactgaatgtaattggcccatttgccttggtgggtgctggcctattagtgattagttaacaaaacacagcgtacagagagcacagaaaagcttaatgacctgctactgaaacacctagccagcagtgaaaatgttaattcttttcttgtttggaaagtatacacgtcttggaattttttccacgtgaaaaacaaatggcaatgaatgcatttaaagatattgccgacagatttttaaatctttttaccaggaaacttcctaaaggttaaatgaattaatgcaaatatcaggctccctctgagtctgtgggagcctctatctctctatcaggaattcgcatccctactattgggaggagcaacattttatttctctgaacgcctaagctccctgggtgggagtggggactacaaggtaggggccagggttggagggcattgtagtggctgctgcctcctgatgaactgtttggggaccccagctctactcaaaagggagcggagataaatggaacccctcacactgctgaggcccgtgttactgttcattcagccaggtggcatgtacctcacagactgttgtgcagtgtccgttattgcagattttaatcatttgcatgctcatcaatttctaagataaatagggtctagagtcataagaatccattgttttcaaggaacttgcagaattacatcatttcctattagtagagagcactacccattttgaaaatctgatatgaaagttgttttttactcttgtaaaaaaagactttcttagtcaaactaacttttcatattttcaagcattctgattcatactcttgctagtggaagaagagagcaagctgccctgctcttttcctttgaggactgaaatagttaaagagaaatcaatgaacaaagtcactcccaaccattttcctgtaaagctggttattatttctcaaggaacctacactttgaatatgtgttaccgagatacctctacatgtggaattatcaacatgttttgaatgagagcagaaatgaacagactggaaaaatctatctcttggtttctatttctctgactttttgagtcgaaaagcataaaggtagaaattcttatttaagctgcttctagtggtgcctgagctggttttgatggtggcatcaaactaccgatttaaaactggaagttgctggtactcaaaccaaaagttcatactctggcgacacgaagggtttcctttgagcaacgtcagctgctgagtccttgtgttcagttcccattgaggagagttggcttttatccatttcaaagcatttgtaggccagccaagggctttcattattgaggcttctagtggcctctggttaacctagaagttagtgggtttttcttgatgacaccaacctctcacagcgtttttccttagagacttaagcagagttttaaaatcctcttttgcgaaaagaacaaatatgttttatgactttgatgatatcttcattctgggcaaaagaatggccctagaaccagctagaagtgaagagaatccattaatgatcaaccacctgagtcaataatgagaaatcagtactgatgttacatttgtggctatttcttgctgactttcaaaggtcaaggactcttgactaatccagtgactgcaaaaatggatctactaaaagtcatctagccagaagtagagatttttaacctttctttccctggcttttgtcttctagctatcatttaaatttgagacatttgaagtattaagaaacaatttttctgtatggtaagaaacagtattttacaatactgaagccctgttttattcaatcttgcatcttgaatacaatataccacaaagtcggaaactttatatttatttactgcaggtggttaaaaaaaggggggaaagggtttcaccatccactgacaacgagagccatgacaaatagtatccatgtgcagtcttccaactgctggtgacaatgaccccatatttggtctcatgctgcttttgcagagcactctgtaggttagtccatcacacaaggaggccctgaatccagacactgtgaattaagaccttggcggggagagatgtgacccttttggtaggaatgggaagaagaatgggtggaagccaatatgaaatttcttctttgcaatgacttgacaggggagttaatgttcctaggatgccatgaatgatgaatgttagttggaggtaatgctgtatatgtgtgtgtgtgtgtgtgtgtgtgtttgtgtgtgtgtatatatatgtgtgtgtgtatatatatgtgacatgtgtgtgtctttgtgtgtgtgtatatatatgtgacgtgtgtgtgggatgtgtgtgtgtatatatagatgaatatatacaaatatatagatatatacacacatatatagatatatatacacatatatagatatatatacacacatatatagatacacatatgtgtgtgtgtgtatatatatatatatatatatatagatgtataggcttgtgagaaacttgagaggaagaagcatgctcttctaggaatgtgaggaaatatgaccttgccaagactaaaagacctctagactgtgagctcagttatggagaacaaaaacagcttcatagtgagtagaacaccgaggataaacactggggccatgggtcctttctgaggcagcgccacagaagatctttgtggtccttccgtagttctgtaagtctgtctcctaagtatgggtagagaatatgtagcctgttgtgtgtctcccactacttgtaaacagagcatcacattaggggcagggaggaggtggaatgatattggaggtgcttaaccctactcgaggaattaattatgaataaagagcttataattagctaacatgactagaaaacacatgacttaggtggagagttagctttcttttctagtttgtgtatgacttgccatttgtgacgtatacaccaaaagatctggtgttttagacttctgccattcacttggcatttaaatctctctttgcttatgctgttaacgagtatgccataggataggacaaattcagtaaacaggaaaacttgtccatatttgcatagacatttgtagggttttttttttctttttctttttagaacttcaccattggcttaagaatgtagttcccaaaacaattttttcttgcaaagtactttccttacacctcttggctacagggtgggccaaattaaacatatatgtattttcatttaatgtatgtgcagtttggtttatcatcttaagatggtggtgctgccccggtgctacttcatctgtgtacacaaagaccaatgcatggtctgtattgctaccaaaacatttactgtatatatgtttataacatgtattatgtatatatgtaatgggtgccaggccaggtatatattttttatttagaagtgtttcacttttccaagttttctttatagtgttatgcttattttcaattttttttttcctgattctgtctggtacttagaattgtagtgtcttcatcatcaattaaagaaaactgtctaaatgaattcatggatgtaaatattagtggtccttaatgtctttgattgctggacatgaaacaaactgccaattaaattttgcggagacatttga

SEQ ID NO: 726 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylcytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tcagtagatggtacgatgcat

SEQ ID NO: 727 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ctaaatgacctcagcaaatcc

SEQ ID NO: 728 - RNA, 21 nt, synthetic construct
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
ttgactgaactgcacgttcta

SEQ ID NO: 729 - RNA, 21 nt, synthetic construct
  modified_base 1: mod_base = OTHER; note = 2'-O-methylcytidine-3'-phosphorothioate
  modified_base 2: mod_base = OTHER; note = 2'-O-methyladenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
cattgactgaactgcacgttc

SEQ ID NO: 730 - RNA, 21 nt, synthetic construct
  modified_base 1: mod_base = OTHER; note = 2'-O-methyluridine-3'-phosphorothioate
  modified_base 2: mod_base = OTHER; note = 2'-O-methylguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
tgaagacctaaatgacctcag

SEQ ID NO: 731 - RNA, 21 nt, synthetic construct
  modified_base 1: mod_base = OTHER; note = 2'-O-methyladenosine-3'-phosphorothioate
  modified_base 2: mod_base = OTHER; note = 2'-O-methylcytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'-phosphate
  misc_feature 1: note = RNA
  misc_feature 2: note = RNA
  misc_feature 3: note = RNA
  misc_feature 4: note = RNA
  misc_feature 5: note = RNA
  misc_feature 6: note = RNA
  misc_feature 7: note = DNA
  misc_feature 8: note = RNA
  misc_feature 9: note = DNA
  misc_feature 10: note = DNA
  misc_feature 11: note = DNA
  misc_feature 12: note = RNA
  misc_feature 13: note = RNA
  misc_feature 14: note = RNA
  misc_feature 15: note = RNA
  misc_feature 16: note = RNA
  misc_feature 17: note = RNA
  misc_feature 18: note = RNA
  misc_feature 19: note = RNA
  misc_feature 20: note = RNA
  misc_feature 21: note = RNA
  source 1..21: mol_type = other RNA
actgcacgttctatattgtgc

What is claimed is:

1. An RNAi agent that inhibits expression of insulin receptor substrate-1 (IRS1) comprising an antisense strand and a sense strand that at least partially complements the antisense strand, wherein: (a) the antisense strand comprises the nucleobase sequence of SEQ ID NO: 677; and/or (b) the sense strand comprises the nucleobase sequence of SEQ ID NO: 689.

2. The RNAi agent of claim 1, wherein one or more bases of the antisense stand and/or the sense strand are modified.

3. The RNAi agent of claim 2, wherein the antisense strand has a modification pattern according to nsNfsnnnNfnnnnnnnNfnNfnnnnnsnsn; or the sense strand has a modification pattern according to nsnsnnnnNfnNfNfNfnnnnnnnnsnsn or nsnsnnnnNfnNfNfNfnnnnnnnnnn;

wherein:

n is a 2'-Ome modified nucleotide, s is a phosphorothioate linkage, and

Nf is a 2'-fluoro modified nucleotide.

4. The RNAi agent of claim 1, wherein:

(a) the antisense strand comprises a modified nucleotide sequence of SEQ ID NO: 701; and (b) the sense strand comprises a modified nucleotide sequence of SEQ ID NO: 713 or 729.

5. The RNAi agent of claim 1, further comprising a targeting ligand conjugated to the antisense strand or the sense strand, wherein the targeting ligand targets a hepatocyte.

6. The RNAi agent of claim 1, wherein the antisense strand and the sense strand form a duplex of at least 14 bases in length.

7. The RNAi agent of claim 1, wherein the antisense strand comprises the nucleobase sequence of SEQ ID NO: 677.

8. The RNAi agent of claim 1, wherein the sense strand comprises the nucleobase sequence of SEQ ID NO: 689.

9. The RNAi agent of claim 1, wherein the antisense strand comprises a modified nucleotide sequence of SEQ ID NO: 701.

10. The RNAi agent of claim 1, wherein the sense strand comprises a modified nucleotide sequence of SEQ ID NO: 713 or 729.

11. The RNAi agent of claim 1, wherein the sense strand comprises the nucleobase sequence of SEQ ID NO: 689 and the antisense strand comprises the nucleobase sequence of SEQ ID NO: 677.

12. The RNAi agent of claim 1, wherein the sense strand comprises a modified nucleotide sequence of SEQ ID NO: 729 and the antisense strand comprises a modified nucleotide sequence of SEQ ID NO: 701.

13. The RNAi agent of claim 12, wherein the RNAi agent comprises a targeting ligand comprising a structure according to Formula I:

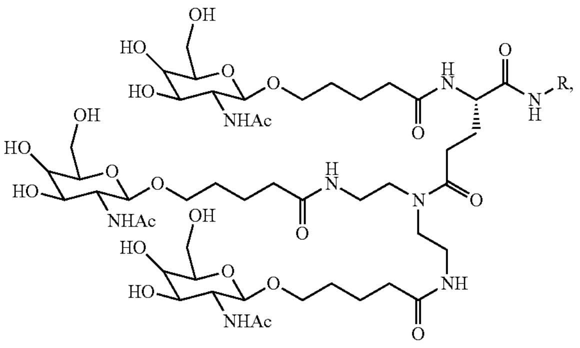

wherein the targeting ligand is conjugated to the 3' end of the sense strand, wherein R comprises a structure according to Formula III:

Formula III

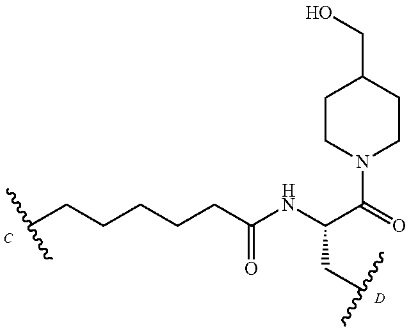

and wherein connection point C of Formula III is conjugated to Formula I, and connection point D of Formula III is conjugated to the 3' end of the sense strand.

14. The RNAi agent of claim 5, wherein the targeting ligand is conjugated to the sense strand.

15. The RNAi agent of claim 14, wherein the targeting ligand is conjugated to the 3' end of the sense strand.

16. The RNAi agent of claim 14, wherein the targeting ligand is conjugated to the 5' end of the sense strand.

17. The RNAi agent of claim 5, wherein the targeting ligand is conjugated to the antisense strand.

18. The RNAi agent of claim 17, wherein the targeting ligand is conjugated to the 3' end of the antisense strand.

19. The RNAi agent of claim 17, wherein the targeting ligand is conjugated to the 5' end of the antisense strand.

20. The RNAi agent of claim 5, wherein the targeting ligand comprises a galactose trimer.

21. The RNAi agent of claim 12, wherein the RNAi agent comprises a targeting ligand and linker according to Formula V:

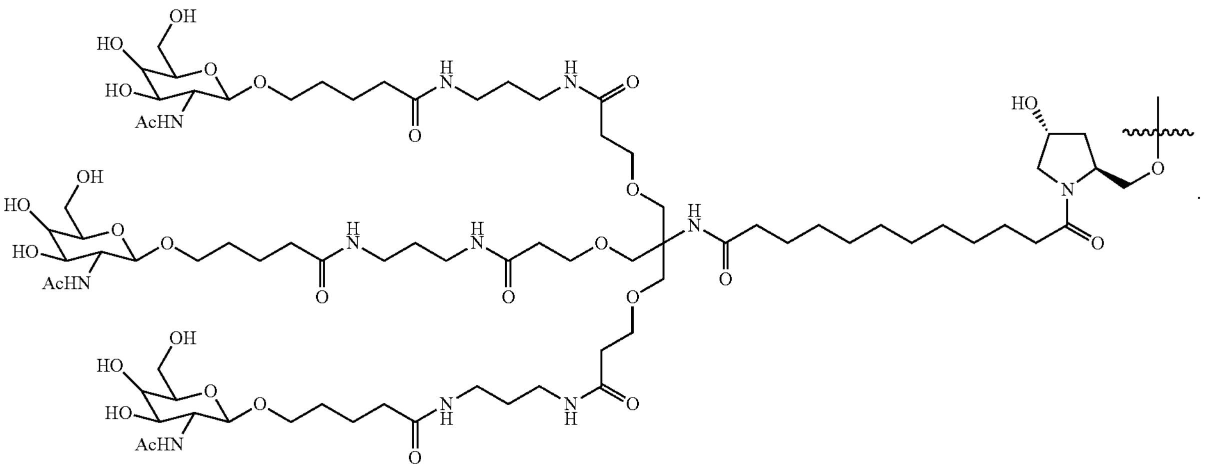 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

22. A pharmaceutical composition comprising the RNAi agent of claim 1 and a pharmaceutically acceptable carrier.

23. A lipid nanoparticle comprising the RNAi agent of claim 1.

24. A method of making a pharmaceutical composition, comprising combining the RNAi agent of claim 1 with a delivery vehicle selected from the group consisting of a phosphate-buffered saline (PBS), lipid, a nanoparticle, a polymer, a liposome, a micelle, a dynamic polyconjugate (DPC), and antibody-oligo conjugate.

25. A method of producing the RNAi agent of claim 1, comprising annealing together the sense strand and the antisense strand.

26. The RNAi agent of claim 1, wherein:

the sense strand is 21 nucleotides in length and comprises a modified nucleotide sequence of SEQ ID NO: 729;

the antisense strand is 23 nucleotides in length and comprises a modified nucleotide sequence of SEQ ID NO: 701; and the RNAi agent comprises a targeting ligand conjugated to the 3' end of the sense strand, the targeting ligand and linker according to Formula V:

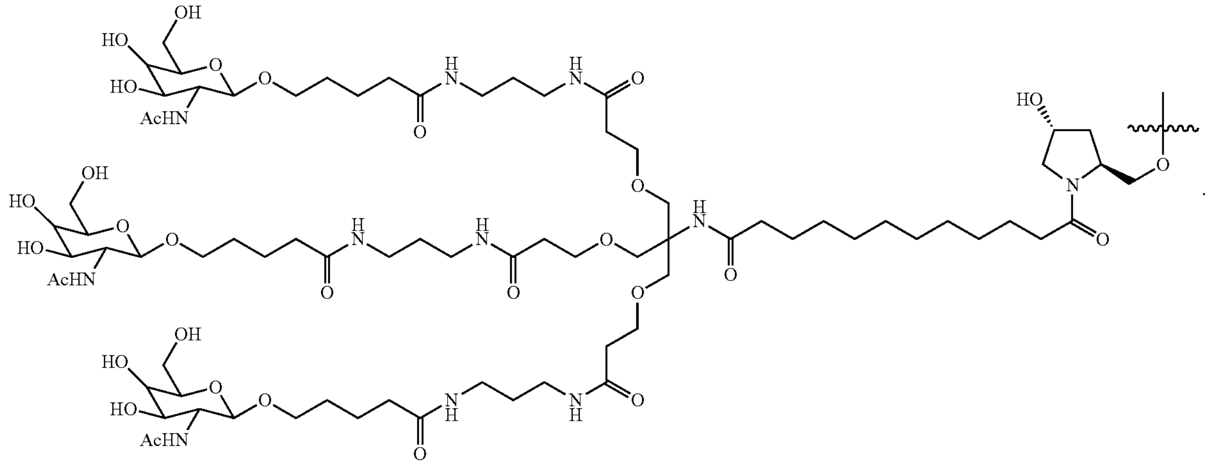 [SMILES: *OC[C@@H]1C[C@@H](O)CN1C(=O)CCCCCCCCCCC(=O)NC(COCCC(=O)NCCCNC(=O)CCCCOC1OC(CO)C(O)C(O)C1NC(C)=O)(COCCC(=O)NCCCNC(=O)CCCCOC1OC(CO)C(O)C(O)C1NC(C)=O)COCCC(=O)NCCCNC(=O)CCCCOC1OC(CO)C(O)C(O)C1NC(C)=O]

.

27. The RNAi agent of claim 1, wherein:

the sense strand is 21 nucleotides in length and comprises a modified nucleotide sequence of SEQ ID NO: 729;

the antisense strand is 23 nucleotides in length and comprises a modified nucleotide sequence of SEQ ID NO: 701; and the RNAi agent comprises a targeting ligand conjugated to the 3' end of the sense strand, the targeting ligand comprising a structure according to Formula I:

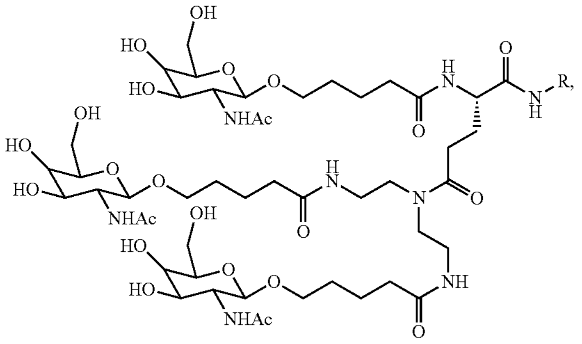

wherein R comprises a structure according to Formula III:

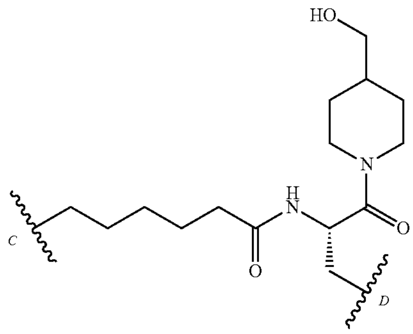

and wherein connection point C of Formula III is conjugated to Formula I, and connection point D of Formula III is conjugated to the 3' end of the sense strand.

* * * * *